US007666427B2

(12) United States Patent
Nabel et al.

(10) Patent No.: US 7,666,427 B2
(45) Date of Patent: Feb. 23, 2010

(54) HIV VACCINES BASED ON ENV OF MULTIPLE CLADES OF HIV

(75) Inventors: Gary J. Nabel, Washington, DC (US); Bimal Chakrabarti, Gaithersburg, MD (US); Wing-pui Kong, Germantown, MD (US); Yue Huang, Bethesda, MD (US); Zengguang Wang, legal representative, Silver Spring, MD (US); Zhi-yong Yang, Potomac, MD (US)

(73) Assignee: The United States of America as represented by the Secretary of the Department of Health and Human Services, Washington, DC (US)

( * ) Notice: Subject to any disclaimer, the term of this patent is extended or adjusted under 35 U.S.C. 154(b) by 76 days.

(21) Appl. No.: 11/818,113

(22) Filed: Jun. 13, 2007

(65) Prior Publication Data

US 2008/0286306 A1 Nov. 20, 2008

Related U.S. Application Data

(63) Continuation of application No. 11/376,484, filed on Mar. 15, 2006, now abandoned, which is a continuation of application No. PCT/US2004/030284, filed on Sep. 15, 2004.

(60) Provisional application No. 60/503,509, filed on Sep. 15, 2003.

(51) Int. Cl.
*A61K 39/00* (2006.01)
(52) U.S. Cl. .................................. 424/184.1; 424/208.1
(58) Field of Classification Search ........................ None
See application file for complete search history.

(56) References Cited

U.S. PATENT DOCUMENTS

2003/0064054 A1  4/2003  Dong

FOREIGN PATENT DOCUMENTS

| WO | WO 97/27311 A1 | 7/1997 |
| WO | WO 01/47955 A2 | 7/2001 |
| WO | WO 02/32943 | * 4/2002 |
| WO | WO 02/072754 A2 | 9/2002 |
| WO | WO 03/076591 A2 | 9/2003 |

OTHER PUBLICATIONS

Tramont et al., Progress in the Development of an HIV Vaccine, Expert Opin. Emerging Drugs, 2002, 8(1):37-45.*
Boaz (IAVI Report, Dec. 2002/Jan. 2003).*
Amara, R.R. et al. 2001 "Control of a mucosal challenge and prevention of AIDS by a multiprotein DNA/MVA vaccine." *Science* 292:69-74.
Barouch, D.H. et al. 2000 "Control of viremia and prevention of clinical AIDS in rhesus monkeys by cytokine-augmented DNA vaccination." *Science* 290:486-492.
Barouch, D.H. et al. 2002 "Eventual AIDS vaccine failure in a rhesus monkey by viral escape from cytotoxic T lymphocytes." *Nature* 415:335-339.
Bojak, A. et al. 2002 "Muscle specific versus ubiquitous expression of Gag based HIV-1 DNA vaccines: a comparative analysis." *Vaccine* 20:1975-1979.
Bonnet, M.C. et al. 2000 "Recombinant viruses as a tool for therapeutic vaccination against human cancers." *Immunol. Lett.* 74:11-25.
Borrow, P. et al. 1994 "Virus-specific CD8+ cytotoxic T-lymphocyte activity associated with control of viremia in primary human immunodeficiency virus type 1 infection." *J. Virol.* 68:6103-6110.
Cao, H. et al. 1997 "Cytotoxic T-lymphocyte cross-reactivity among different human immunodeficiency virus type 1 clades: implications for vaccine development." *J. Virol.* 71:8615-23.
Chakrabarti, B.K. et al. 2002 "Modifications of the human immunodeficiency virus envelope glycoprotein enhance immunogenicity for genetic immunization." *J. Virol.* 76:5357-5368.
Chakrabarti, B.K. et al. 2005 "Expanded breadth of virus neutralization after immunization with a multiclade envelope HIV vaccine candidate." *Vaccine* 23:3434-3445.
Deml, L. et al. 2001 "Multiple effects of codon usage optimization on expression and immunogenicity of DNA candidate vaccines encoding the human immunodeficiency virus type 1 Gag protein." *J. Virol.* 75:10991-11001.
Dorrell, L. et al. 2001 "Cytotoxic T lymphocytes recognize structurally diverse, clade-specific and cross-reactive peptides in human immunodeficiency virus type-1 gag through HLA-B53." *Eur. J. Immunol.* 31:1747-1756.
Goepfert, P.A. et al. 2000 "A significant number of human immunodeficiency virus epitope-specific cytotoxic T lymphocytes detected by tetramer binding do not produce gamma interferon." *J. Virol.* 74:10249-10255.
Huang, Y. et al. 2001 "Human immunodeficiency virus type 1-specific immunity after genetic immunization is enhanced by modification of Gag and Pol expression." *J. Virol.* 75:4947-4951.
Jin, X. et al. 1999 "Dramatic rise in plasma viremia after CD8+ T cell depletion in simian immunodeficiency virus-infected macaques." *J. Exp. Med.* 189:991-998.
Keating, S.M. et al. 2002 "Cross-clade T lymphocyte-mediated immunity to HIV type 1: implications for vaccine design and immunodetection assays." *AIDS Res. Hum. Retroviruses* 18:1067-1079.
Kim, J. et al. 2001 "Protection from immunodeficiency virus challenges in rhesus macaques by multicomponent DNA immunization." *Virology* 285:204-217.
Kjerrstrom, A. et al. 2001 "Interactions of single and combined human immunodeficiency virus type 1 (HIV-1) DNA vaccines." *Virology* 284:46-61.

(Continued)

*Primary Examiner*—Stacy B Chen
*Assistant Examiner*—Nicole Kinsey White
(74) *Attorney, Agent, or Firm*—Leydig, Voit & Mayer, Ltd.

(57) ABSTRACT

In one embodiment, the invention provides a multiclade HIV plasmid DNA or viral vector vaccine including components from different clades of Env (optionally Env chimeras) and Gag-Pol-(optionally)Nef from a single clade. The vaccine of the invention may further include V1, V2, V3, or V4 deletions or combinations thereof. In another embodiment, the invention provides multiclade HIV envelope immunogens.

42 Claims, 109 Drawing Sheets

OTHER PUBLICATIONS

Klein, M.R. et al. 1995 "Kinetics of gag-specific cytotoxic T lymphocyte responses during the clinical course of HIV-1 infection: a longitudinal analysis of rapid progressors and long-term asymptomatics." *J. Exp. Med.* 181:1365-1372.

Kong, W.P. et al. 2003 "Immunogenicity of multiple gene and clade human immunodeficiency virus type 1 DNA vaccines." *J. Virol.* 77:12764-12772.

Koup, R.A. et al. 1994 "Temporal association of cellular immune responses with the initial control of viremia in primary human immunodeficiency virus type 1 syndrome." *J. Virol.* 68:4650-4655.

Letvin, N.L. 2002 "Strategies for an HIV vaccine." *J. Clin. Investig.* 110:15-20.

Maecker, H.T. et al. 2001 "Use of overlapping peptide mixtures as antigens for cytokine flow cytometry." *J. Immunol. Methods* 255:27-40.

Mascola, J.R. et al. 2001 "Vaccines for the prevention of HIV-1 disease." *Curr. Opin. Immunol.* 13:489-495.

McKay, P.F. et al. 2002 "Vaccine protection against functional CTL abnormalities in simian human immunodeficiency virus-infected rhesus monkeys." *J. Immunol.* 168:332-337.

Migueles, S.A. et al. 2001 "Frequency and function of HIV-specific CD8+ T cells." *Immunol. Lett.* 79:141-150.

Mortara, L. et al. 1998 "Selection of virus variants and emergence of virus escape mutants after immunization with an epitope vaccine." *J. Virol.* 72:1403-1410.

Moss, B. 1996 "Genetically engineered poxviruses for recombinant gene expression, vaccination, and safety." *PNAS USA* 93:11341-11348.

Moss, P.A. H. et al. 1995 "Persistent high frequency of human immunodeficiency virus-specific cytotoxic T cells in peripheral blood of infected donors." *PNAS USA* 92:5773-5777.

Musey, L. et al. 1997 "Cytotoxic-T-cell responses, viral load, and disease progression in early human immunodeficiency virus type 1 infection." *N. Engl. J. Med.* 337:1267-1274.

Muthumani, K. et al. 2002 "Issues for improving multiplasmid DNA vaccines for HIV-1." *Vaccine* 20:1999-2003.

Nabel, G.J. 2001 "Challenges and opportunities for development of an AIDS vaccine." *Nature* 410:1002-1007.

NIAID Phase III HIV vaccine trial to determine correlates of protection will not proceed. NIAID News, Feb. 25, 2002, retrieved from the World Wide Web at htlp:/lwww2.niaid.nih.gov/newsroom/releaseslphase3hiv.htm.

Novitsky, V. et al. 2001 "Identification of human immunodeficiency virus type 1 subtype C Gag-, Tat-, Rev-, and Nef-specific ELISpot-based cytotoxic T-lymphocyte responses for AIDS vaccine design." *J. Virol.* 75:9210-9228.

Ogg, G.S. et al. 1998 "Quantitation of HIV-1-specific cytotoxic T lymphocytes and plasma load of viral RNA." *Science* 279:2103-2106.

Ramsay, A.J. et al. 1997 "DNA vaccination against virus infection and enhancement of antiviral immunity following consecutive immunization with DNA and viral vectors." *Immunol. Cell Biol.* 75:382-388.

Rerks-Ngarm et al. 2006 "HIV/AIDS preventive vaccine 'prime boost' phase iii trial: foundations and initial lessons learned from Thailand."*AIDS* 20:1471-1479.

Rowland-Jones, S.L. et al. 1993 "HIV-specific cytotoxic T-cell activity in an HIV-exposed but uninfected infant." *Lancet* 341:860-861.

Rowland-Jones, S.L. et al. 1995 "HIV-specific cytotoxic T-cells in HIV-exposed but uninfected Gambian women." *Nat. Med.* 1:59-64.

Rowland-Jones, S.L. et al. 1998 "Cytotoxic T cell response to multiple conserved HIV epitopes in HIV-resistant prostitutes in Nairobi." *J. Clin. Investig.* 102:1758-1765.

Rubinstein, A. et al. 1999 "Immunologic responses of HIV-1-infected study subjects to immunization with a mixture of peptide protein derivative-V3 loop peptide conjugates." *J. Acquir. Immune Defic. Syndr.* 22:467-476.

Schmitz, J.E. et al. 1999 "Control of viremia in simian immunodeficiency virus infection by CD8+ lymphocytes." *Science* 283:857-860.

Shiver, J.W. et al. 2002 "Replication-incompetent adenoviral vaccine vector elicits effective anti-immunodeficiency-virus immunity." *Nature* 415:331-335.

Srivastava, I.K. et al. 2003 "Changes in the immunogenic properties of soluble gp140 human immunodeficiency virus envelope constructs upon partial deletion of the second hypervariable region." *J. Virol.* 77:2310-2320.

Stamatatos at al. 1998 "An envelope modification that renders a primary, neutralization-resistant clade B human immunodeficiency virus type I isolate highly susceptible to neutralization by sera from other clades." *J. Virol.* 72:7840-7845.

Van Der Groen, G. et al. 1998 "Genetic variation of HIV type 1: relevance of interclade variation to vaccine development." *AIDS Res. Hum. Retrovir.* 14(Suppl. 3):S211-S221.

Yang, Z. et al. 1998 "Distinct cellular interactions of secreted and transmembrane Ebola virus glycoproteins." *Science* 279:1034-1037.

Yang, Z. et al. 2004 "Selective modification of variable loops alters tropism and enhances immunogenicity of human immunodeficiency virus type 1 envelope" *J. Virol.* 78:4029-4036.

Zur Megede, J. et al. 2003 "Expression and immunogenicity of sequence-modified human immunodeficiency virus type 1 subtype B pol and gagpol DNA vaccines." *J. Virol.* 77:6197-6207.

Kantakamalakul. W., et.al, Cytotoxic T lymphocyte responses to vaccinia virus antigens but not HIV-1 subtype E envelope protein seen in HIV-1 seronegative Thais, Asian Pacific Journal of Allergy and Immunology 2001 19:1(17-22).

Betts M.R., et al., Cross-Clade Human Immunodeficiency Virus (HIV)-Specific Cytotoxic T-Lymphocyte Responses in HIV-Infected Zambians, Journal of Virology, Nov. 1997, vol. 71, No. 11, p. 8908-8911.

Cao H., et al., Cytotoxic T-Lymphocyte Cross-Reactivity among Different Human Immunodeficiency Virus Type 1 Clades: Implications for Vaccine Development, Journal of Virology, Nov. 1997, vol. 71, No. 11, p. 8615-8623.

Cao H., et al., Cellular Immunity to Human Immunodeficiency Virus Type 1 (HIV-1) Clades: Releveance to HIV-1 Vaccine Trials in Uganda, The Journal of Infectious Diseases, Nov. 2000, vol. 182, p. 1350-1356.

Dorrell L., et al., Distinct Recognition of Non-Clade B Human Immunodeficiency Virus Type 1 Epitopes by Cytotoxic T Lymphocytes Generated from Donors Infected in Africa, Journal of Virology, Feb. 1999, vol. 73, No. 2, p. 1708-1714.

Ferrari G., et al., Clade B-based HIV-1 vaccines elicit cross-clade cytotoxic T lymphocyte reactivities in uninfected volunteers, Proc. Natl. Acad. Sci. USA, Feb. 1997, vol. 94, p. 1396-1401.

Finnefrock, A.C., et al, HIV Type 1 Vaccines for Worldwide Use: Predicting In-Clade and Cross-Clade Breadth of Immune Responses, AIDS Research and Human Retroviruses, Nov. 10, 2007, vol. 23, No. 10, p. 1283-1292.

Larke N., et al., Combined single-clade candidate HIV-1 vaccines induce T cell responses limited by multiple forms of in vivo immune interference, European Journal of Immunology, 2007, vol. 37, p. 566-577.

Moss, R.B., et al., T-Helper-Cell Proliferative Responses to Whole-Killed Human Immunodeficiency Virus Type 1 (HIV-1) and p24 Antigens of Different Clades in HIV-1-Infected Subjects Vaccinated with HIV-1 Immunogen (Remune), Clinical and Diagnostic Laboratory Immunology, Sep. 2000, vol. 7, No. 5, p. 724-727.

Rencher S.D., et al., Eliciting HIV-1 envelope-specific antibodies with mixed vaccinia virus recombinants, Vaccine, 1997, vol. 15, No. 3, p. 265-272.

Slobod, K.S., et al., Glade, Country and Region-specific HIV-1 Vaccines: Are they necessary?, AIDS Research and Therapy, Apr. 2005, vol. 2, No. 3, 1-3.

* cited by examiner

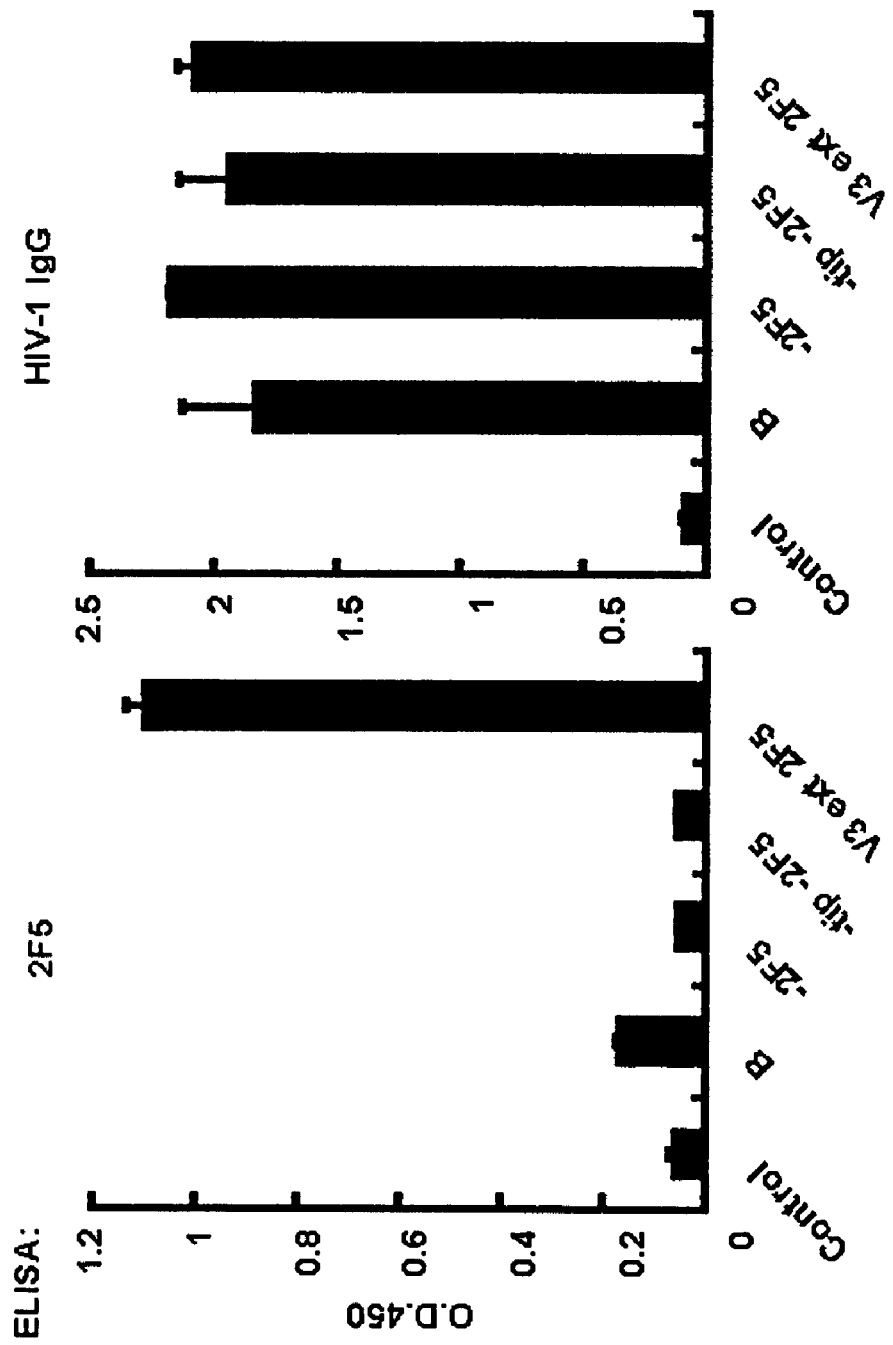

FIG.5C-1  FIG.5C-2  FIG.5C-3

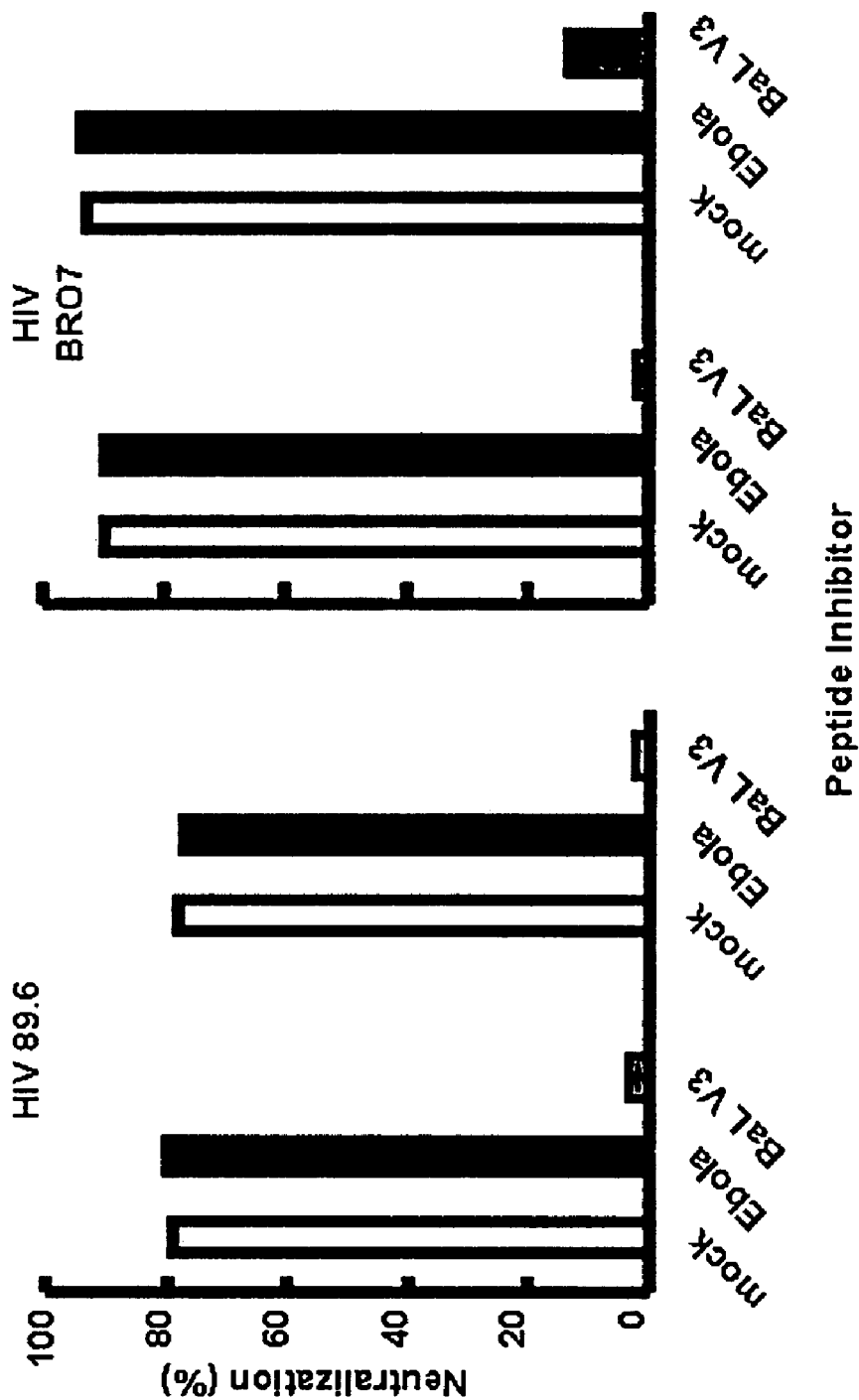

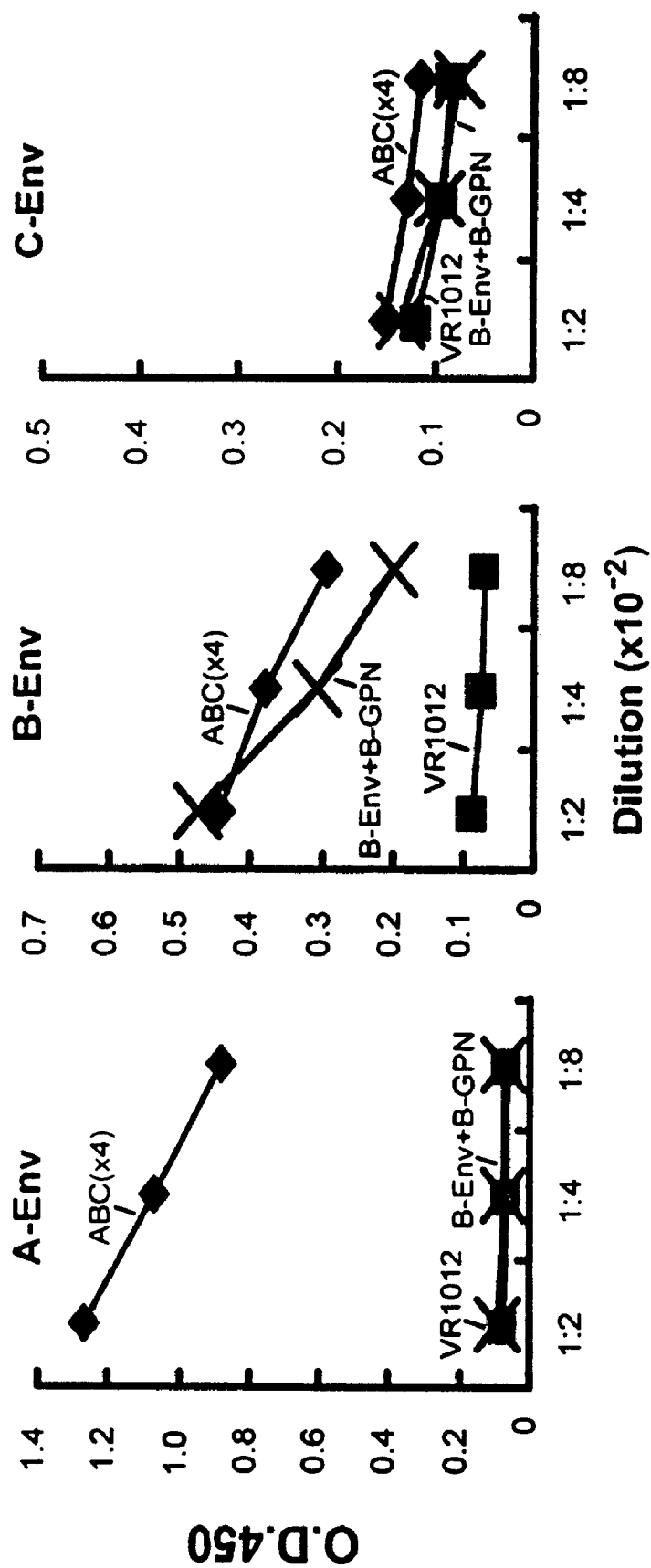

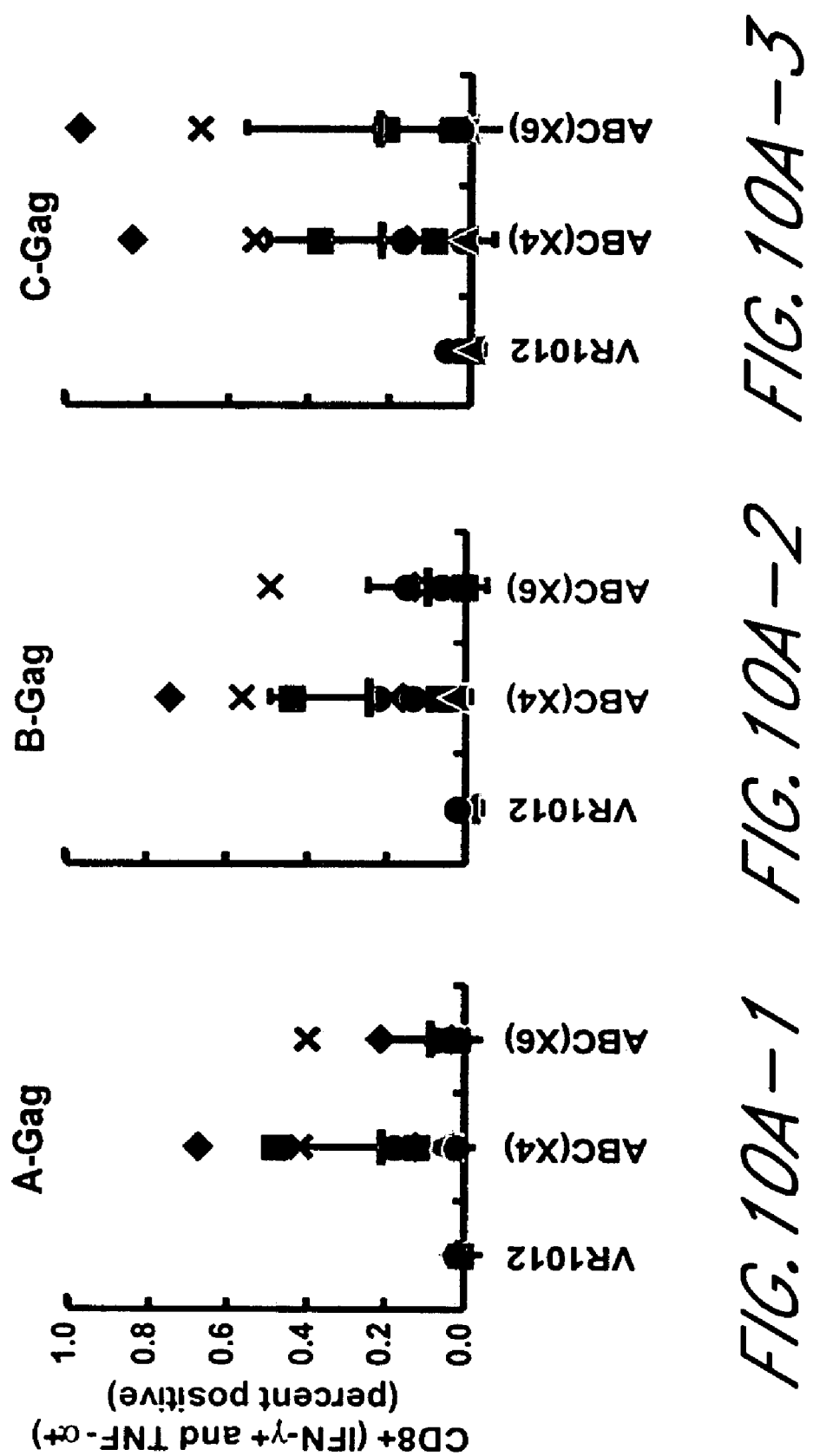

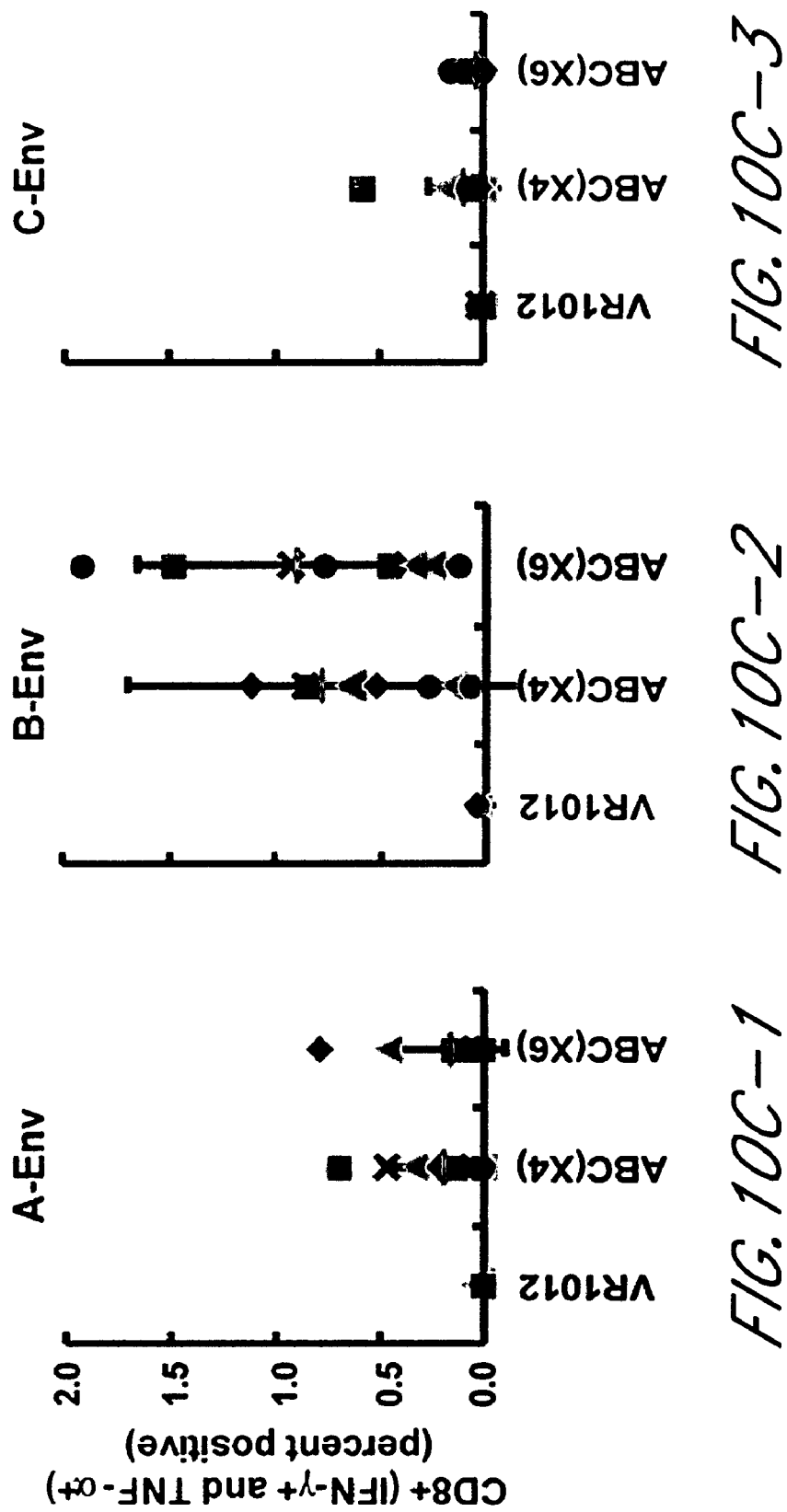

V3 LOOP DELETIONS

| | | |
|---|---|---|
| Null | CTRPNNNTRKSIHIGPGRAFYTTGEIIGDIRQAHC | SEQ ID NO: 1 |
| 1AB | CTRP TRKSIHIGPGRAFYTTGEI IRQAHC | SEQ ID NO: 6 |
| 2AB | CTRP SIHIGPGRAFYTT IRQAHC | SEQ ID NO: 7 |
| 3AB | CTRP IGPGRAF IRQAHC | SEQ ID NO: 8 |
| 4A | CTRPNNNTRKSIHI FYTTGEIIGDIRQAHC | SEQ ID NO: 9 |
| 5AB | CTRPNNNTRE IGPGRAF GEIIGDIRQAHC | SEQ ID NO: 10 |
| 7AB | CTRPNNN IGPGRAF IGDIRQAHC | SEQ ID NO: 11 |

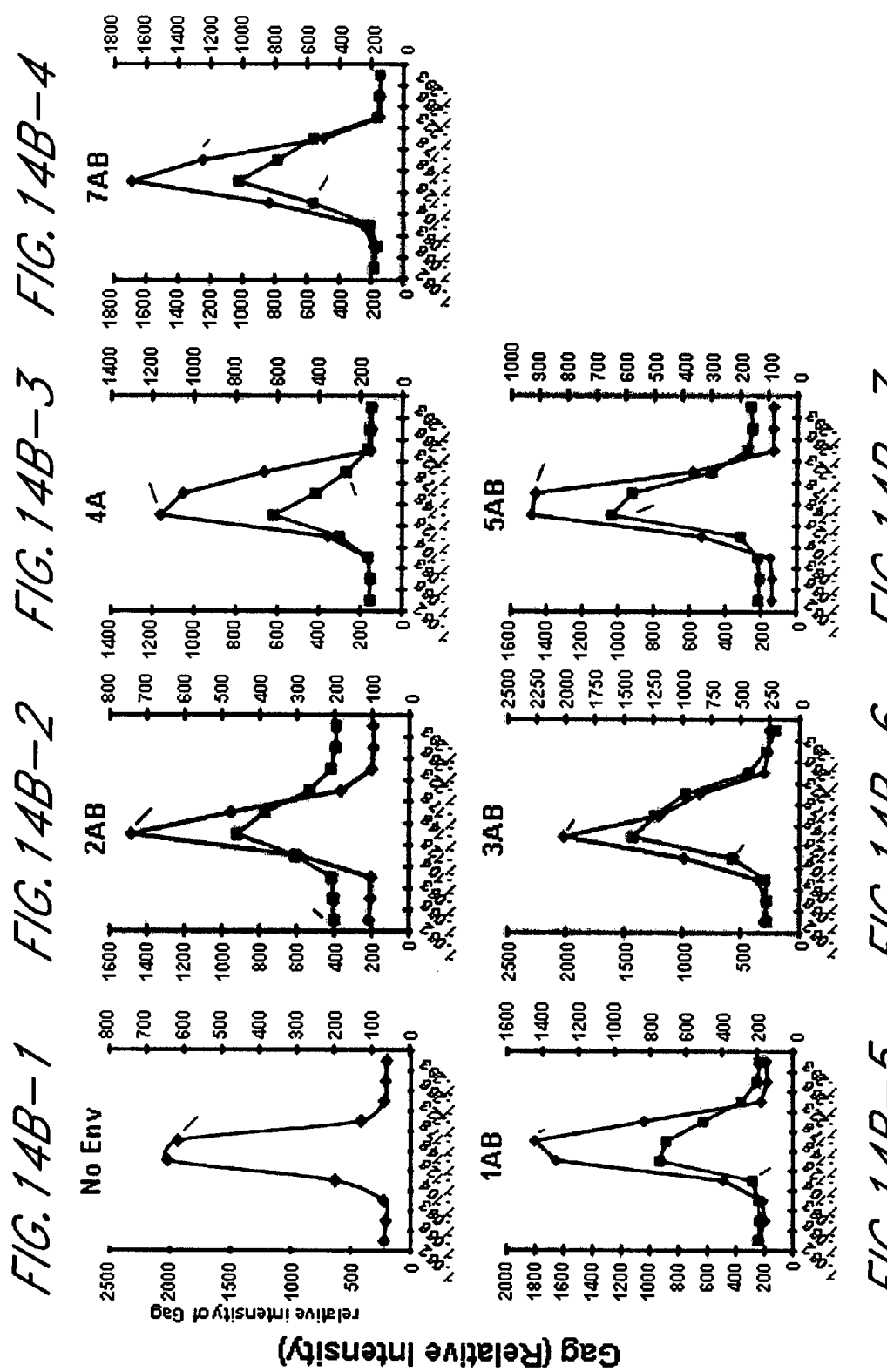

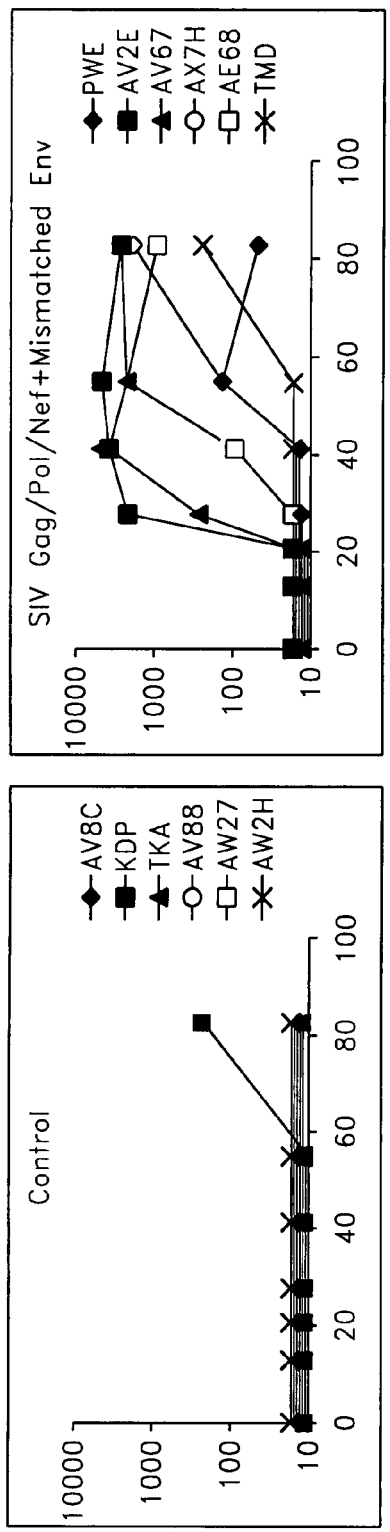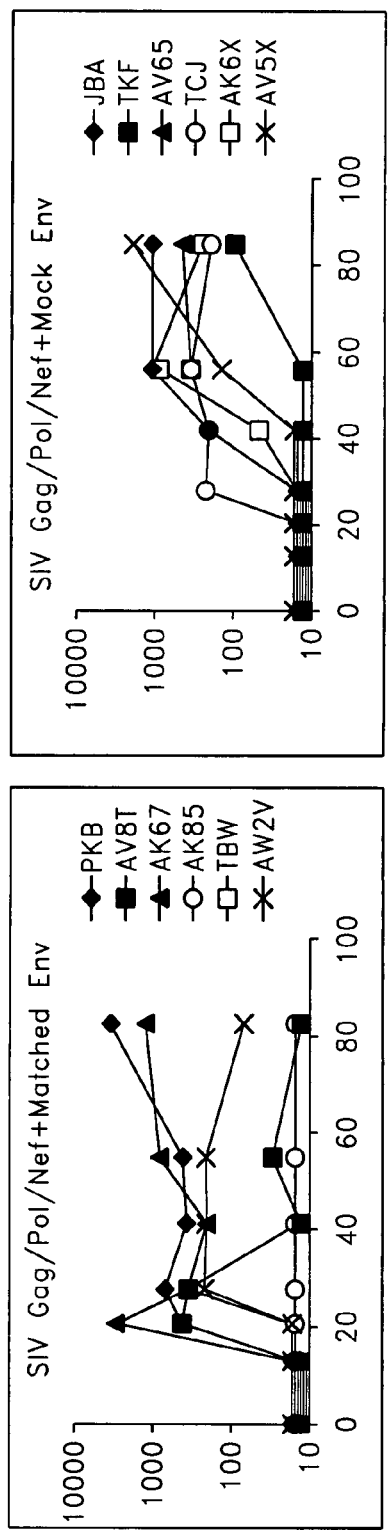

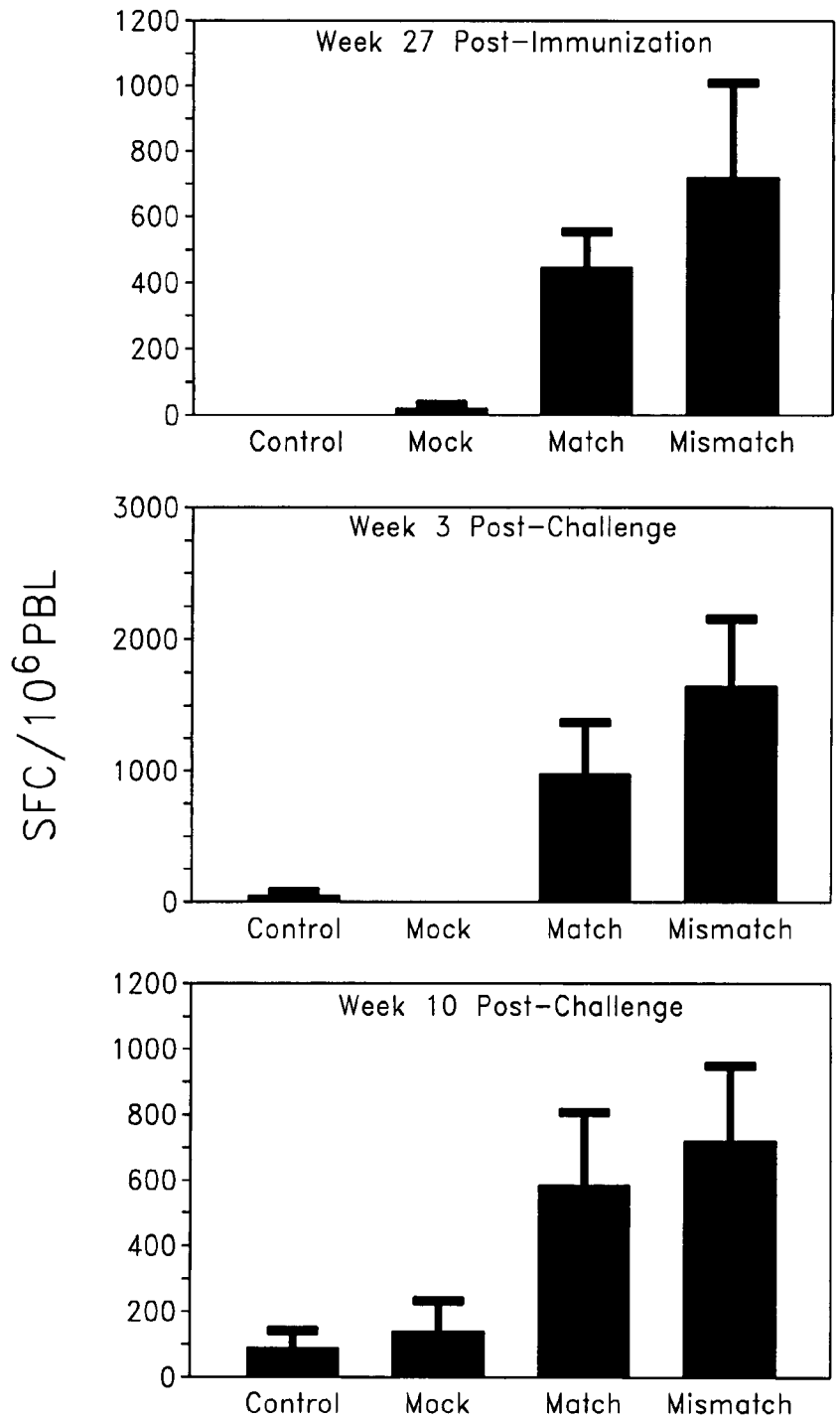

HIV-1 Primary Isolate

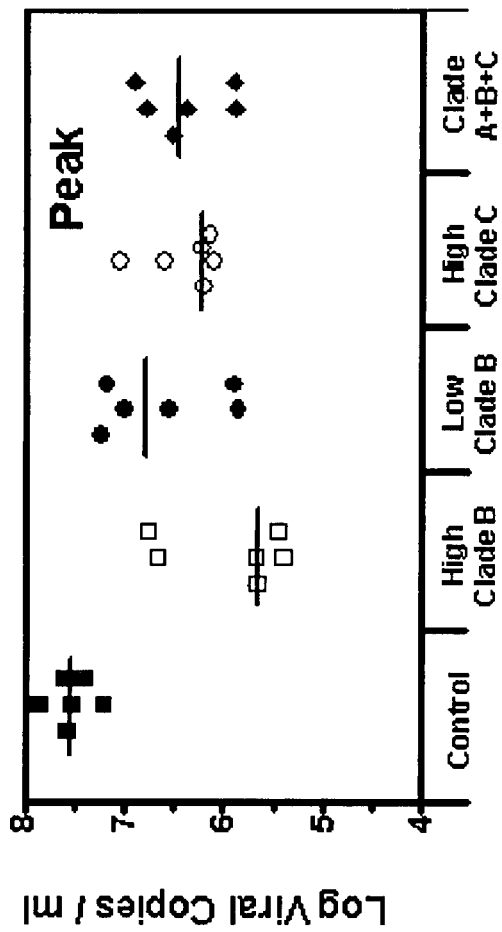
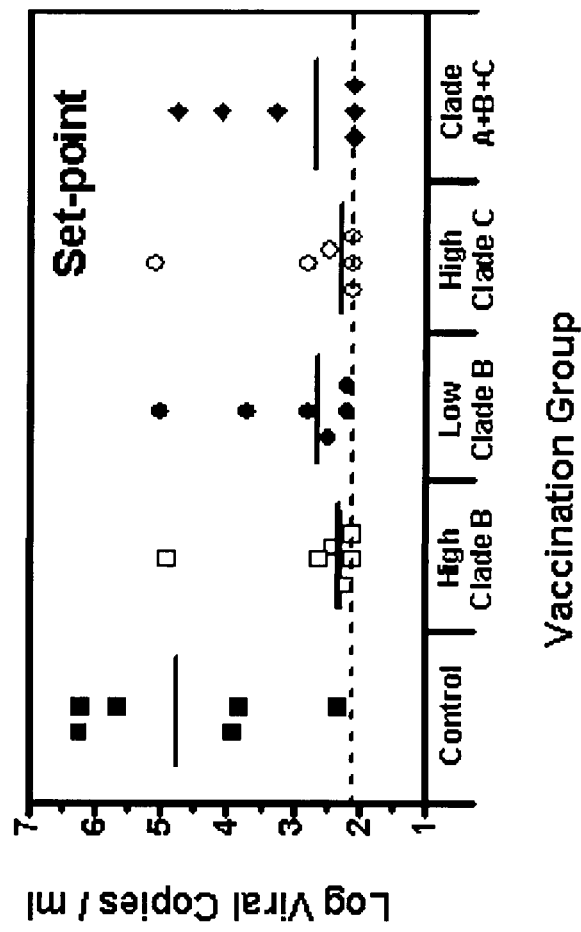
FIG.30A
FIG.30B pAdApt Lox CMV TbGH(+) gp140(dV12)(V3-1AB)/h Clade A

- PacI (6)
- Ad5 (1-454)
- SnaBI (493)
- SpeI (608)
- CMV
- SnaBI (949)
- SalI (1272)
- EcoRV (1291)
- NotI (1296)
- XbaI (1303)
- EcoRV (1311)
- NheI (1717)
- KpnI (1850)
- gp140(dCFI)(dV12)(V3-1AB)Clade A/h
- BglII (2509)
- HindIII (2611)
- BglII (2783)
- XmnI (2935)
- BamHI (2972)
- bovine growth hormone poly A
- LoxP
- BglII (3253)
- ApaI (4371)
- Ad5 (3511-6093)
- ApaI (4677)
- SalI (5842)
- VRC 5767
- 7844 bp
- ampicillin resistance
- XmnI (7444)

FIG. 51

CMV/R-gp145(dCFI)(dV1-2)Clade B (V3-1AB-clade A)/h

- NruI (5740)
- BspDI (5704)
- CsaI (5704)
- Ksp632I (5581)
- EarI (5581)
- SmaI (5523)
- XmaI (5521)
- Kan.
- SspI (5472)
- PvuI (5399)
- MluNI (248)
- MscI (248)
- SpeI (336)
- CMV Enhancer
- SnaBI (677)
- Bsu36I (1030)
- HTLV-1 R Region
- HpaI (1224)
- CMV IE Splicing Acceptor
- SalI (1344)
- AccI (1345)
- PmlI (1351)
- BbrPI (1351)
- PmaCI (1351)
- EcoRV (1363)
- NotI (1368)
- EagI (1368)
- EclXI (1368)
- XmaIII (1368)
- XbaI (1375)
- NheI (1784)
- Bsp120I (1918)
- ApaI (1922)
- SgrAI (2153)
- V3-1AB-clade A
- gp145(dCFI)(dV1-2)(Clade B)(V3-1AB-clade A)/h
- Asp700 (3020)
- XmnI (3020)
- SexAI (2366)
- BcgI (3082)
- BamHI (3122)
- Acc65I (3359)
- Asp718 (3359)
- KpnI (3363)
- Tbgh

VRC 5772
6133 bp

*FIG.56*

CMV/R gp145(dCFI)(V3-1AB)/h Clade C(SA)

- Xho I (5942)
- Kan.
- Eco NI (5631)
- Hind III (5422)
- Bsr GI (280)
- CMV Enhancer/Promoter
- Eco NI (1029)
- HTLV-1 R Region
- Nae I (1181)
- CMV IE Splicing Acceptor
- Xba I (1375)

VRC 5773
6280 bp

- Tbgh
- Sph I (3469)
- Bam HI (3256)
- gp145(dCFI)(V3-1AB)/h Clade C(SA)
- Eco RI (2506)
- Bsr GI (2774)
- Hind III (2830)
- Xho I (2998)

HIV VACCINES BASED ON ENV OF MULTIPLE CLADES OF HIV

RELATED APPLICATIONS

This application is a continuation of U.S. application Ser. No. 11/376,484, filed Mar. 15, 2006, now abandoned which is a continuation of International Patent Application No.: PCT/US2004/030284, filed Sep. 15, 2004, designating the U.S. and published in English on Apr. 21, 2005 as WO 2005/034992, which claims the benefit of U.S. Provisional Application No. 60/503,509 filed Sep. 15, 2003, all of which are expressly incorporated herein by reference in their entireties.

BACKGROUND OF THE INVENTION

1. Field of the Invention

This invention is related to the field of vaccines against HIV.

2. Description of the Related Art

There is a need for a safe and effective vaccine against ever-mutating Human Immunodeficiency Virus (HIV). One requirement of a highly effective AIDS vaccine is the need to induce both neutralizing antibodies and cellular immunity to the many strains of HIV-1 that circulate throughout the world.

SUMMARY OF THE INVENTION

In one embodiment, the invention provides a multiclade HIV plasmid DNA or viral vector vaccine including components from different clades of Env (optionally Env chimeras) and Gag-Pol-(optionally)Nef from a single clade. The vaccine of the invention may further include V1, V2, V3, or V4 deletions or combinations thereof. In another embodiment, the invention provides a multiclade HIV envelope immunogen.

```
CTRPNNNTRKSIHIGPGRAFYTTGEIIGDIRQAHC;  (SEQ ID NO: 1)

CTRPNNNTRKAIHIFYTTGEIIGDIRQAHC;       (SEQ ID NO: 2)

LELDKWAS;                             (SEQ ID NO: 3)

KNEQELLELDKWAS;                       (SEQ ID NO: 4)

KNEKDLLALDSWRN.                       (SEQ ID NO: 5)
```

B. Expression of 2F5 mutant gp140ΔCFI envelopes. Expression of the indicated gp140ΔCFI B(C-HR2) or -2F5, gp140ΔCFIΔGPGRA B(C—HR2) or -tip-2F5, gp140ΔCFI B(C-HR2) ext 2F5, V3 ext 2F5, and clade B gp140ΔCFI are shown. The indicated proteins were detected by immunoblotting as described in Materials and Methods section of PART I. Cell-free supernatants produced by transfection with vector containing no insert were used as controls. C (C-1, C-2). Analysis of the reactivity of 2F5 modified Env with monoclonal antibody, 2F5, and HIV-1 IgG. Binding of gp140ΔCFI indicated mutants or controls transfected with vector alone were analyzed by ELISA with monoclonal antibody 2F5 (left panel) and HIV-1 IgG (right panel). The values represent the mean and standard deviation (error bars) for each point.

Figure 5A:
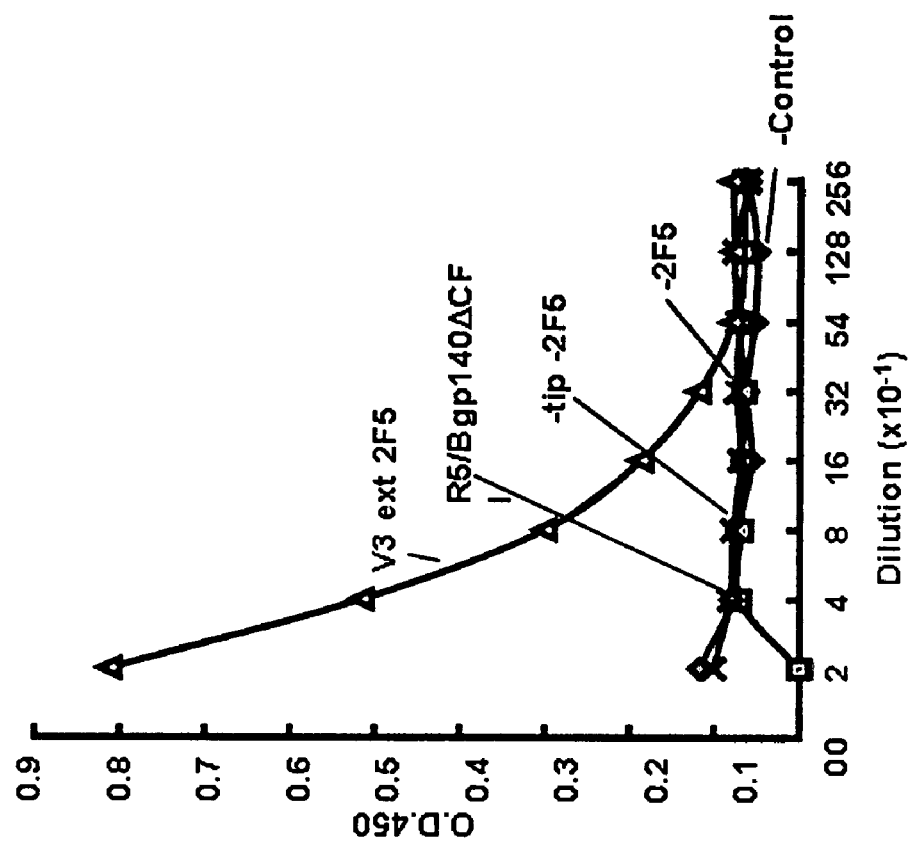
Figure 5B:
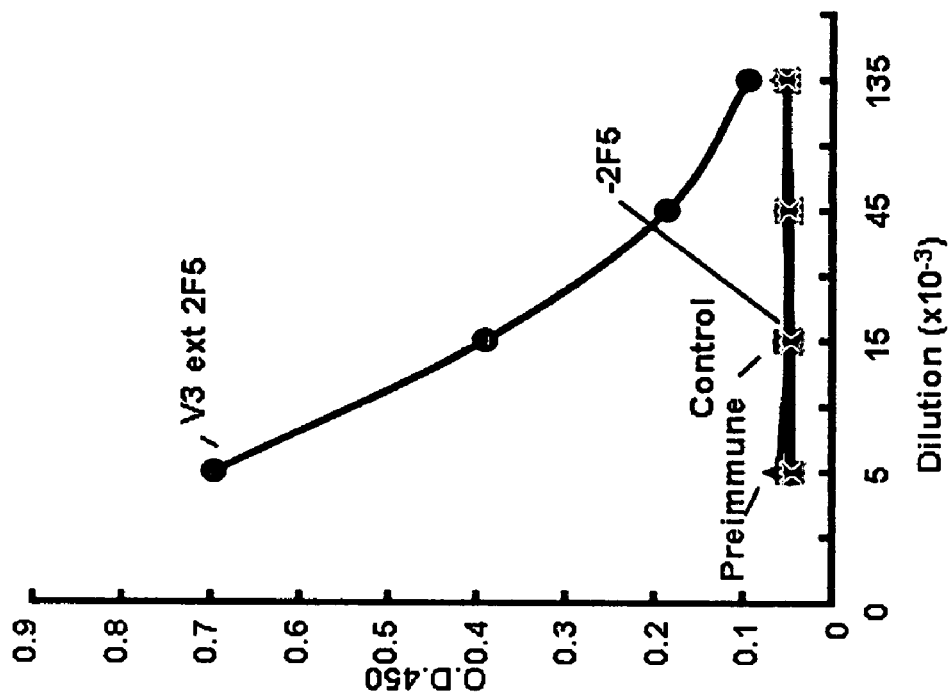

FIG. 5. Antibody response to 2F5 peptide in immunized guinea pigs. Comparison of the antibody response by ELISA in guinea pigs immunized with designated expression vectors. Sera collected 2 weeks after DNA (A.) and ADV boosting (B.) were used to detect the antibody that could bind with 2F5 peptide. Serum from an animal immunized with the control vector alone served as a negative control. C(C-1, C-2, C-3). Percent neutralization of the 2F5/V3 mutants in HIV HXB/BaL ΔCFI Envs is shown against a panel of HIV-1 clade B strains at 1:5 antibody titer. Four individual sera from 2F5/V3 mutants immunized guinea pigs were screened against HIV BaL, HIV IIIB, and HIV SF162 viruses. Percent neutralization (compared with corresponding pre-immune sera) is indicated.

FIG. 6. Interaction of gp140ΔCFI with different monoclonal antibodies or CD4 of gp140ΔCFI from different clades. A. Analysis of the antigenic structure of soluble gp140ΔCFI with monoclonal antibodies. Env glycoproteins from the supernatants of 293 cells transfected with the indicated vector expressing gp140ΔCFI were immunoprecipitated with either monoclonal antibodies (5 μg) 2F5, 2G12, F105, and IgG1b12 or with 5 μg of HIV-1 IgG. The proteins were analyzed by SDS-PAGE and detected by Western blotting using the IgG from the pooled sera of the patient (HIV-1 IgG). The bands that cross-reacted with the antibody are presented. B. Interaction of soluble gp140ΔCFI protein with CD4. Binding of gp140ΔCFI and gp160, compared to that of controls transfected with vector alone, in an ELISA with CD4 is shown. The values represent the mean and standard deviation (error bars) for each point.

FIG. 7. Comparison of breadth and potency of the neutralizing antibody response induced by ΔCFI envelope from clade B (HXB/BaL) and from a combination of clades A, B, and C. A, B. Neutralization assays of indicated viruses at a 1:5 dilution of four individual guinea pig sera. The percent neutralization was calculated by direct comparison of immune sera to the corresponding animals pre-immune sera. The single-round intracellular p24-antigen flow cytometric HIV-1 neutralization assay has been described previously (Mascola, J. R. et al. 2002 *J Virol* 76:4810-21). Panel A shows the results from four guinea pigs immunized with the clade B Env immunogen. Panel B shows results from four guinea pigs immunized with the multiclade immunogen. All sera were evaluated against a panel of 19 viruses (shown on X-axis). Due to the large number of viruses evaluated, data shown are from a single experiment for each sera and virus. Comparison of neutralization by monoclade to multiclade sera for any given virus (DJ263, ZA12, TV1 and DU151) revealed a significant difference (p=0.029). C(C-1, C-2). V3 peptide competition analysis of the neutralization of clade B HIV 89.6 and BR07. Neutralization of HIV 89.6 (left) and HIV BR07 (right) by sera from guinea pigs immunized with HIV HXB/BaL immunogen was tested at 1:5 dilution. The serum was incubated with no peptide (mock), or 20 μg/ml of 23mer V3 peptide based on the HIV BaL sequence (BaL V3) or an unrelated mixture of peptides derived from Ebola GP (Ebola). Infection by HIV 89.6 and HIV BR07 was completely inhibited by the HIV BaL V3 peptide but not by the control peptides. Data from a representative guinea pig serum is shown. D, E. V3 peptide competition analysis of the neutralization of clade B HIV SF162. Panel D shows sera from two representative guinea pigs; one immunized with the clade B Env immunogen (monoclade) and one immunized with the clade A, B, C Env immunogen (multiclade). Sera were tested at a 1:5 dilution and incubated with increasing concentrations of the 23mer V3 peptide based on the HIV BaL sequence. Note that neutralization by the monoclade sera, but not the multiclade sera, was completely inhibited by the HIV BaL V3 peptide. The control values show that the scrambled V3 peptide had no effect on serum neutralization. The bar graph E displays data from neutralization of the HIV SF162 by the same multiclade guinea pig serum, also at a 1:5 dilution. The serum was incubated with 20 μg/ml of either the clade A, B or C V3 peptide, or with 60 μg/ml of a combination of all three peptides (panel E). A combination of all three V3 peptides did not reverse the majority of the serum-mediated neutralization of SF162. Error bars are the mean (+/−SEM) of two independent experiments. Both experiments shown in panel C were done with a single serum, but all four sera in each group (monoclade or multiclade) gave similar results.

FIG. 8. Comparison of immune response of multivalent multi-plasmids with single gene approaches. Four groups of mice with 5 mice per group were immunized with the control vector alone (50 μg), Env (25 μg) with control vector (25 μg) as filler DNA, Gag-Pol-Nef (25 μg) with control vector (25 μg) as filler DNA, or Env (25 μg) with Gag-Pol-Nef (25 μg). Ten days after the final immunization, splenic cells were harvested and sensitized with B-env peptide pool (158-peptide pool of Clade B Env protein) and B-gag peptide pool (122-peptide pool of Clade B Gag protein). Six hours later, the cells were fixed, stained with monoclonal antibodies, and analyzed by FACS to detect the IFN-γ and TNF-α positive cells in the CD4 (top row) and CD8 positive (bottom row) population shown in FIG. 8A (A-1, A-2, A-3, A-4). In the FIG. 8B, mouse sera were collected to detect antibody against Env using ELISA. ELISA plates were prepared and coated as described in Materials and Methods section of PART II with supernatant from cells transfected with pVRC2801 (R5 gp140ΔCFI-Clade-B) from Clade B. Mouse sera from different groups were diluted starting from 1:100 to 1:2700 before testing. The ELISA titers are shown for the group immunized with pVR1012 (▲), with pVR1012-B-Gag-Pol-Nef and filler DNA (■), with pVR1012-B-gp145ΔCFI and filler DNA (●), or with 1012-B-gp145ΔCFI+1012-B-Gag-Pol-Nef (♦). Each point represents the average OD reading from the five animals per group.

FIG. 9. T cell and antibody responses in mice immunized Gag-Pol-Nef and clade B Env compared to Gag-Pol-Nef and clade A, B, C Env proteins. Mice (n=3) were immunized with a total of 50 μg of control vector, Gag-Pol-Nef and clade B Env (1:1 ratio), or Gag-Pol-Nef and Env from clades A, B, and C (1:0.33:0.33:0.33 ratio). (A). Ten days after the final immunization, splenic cells were harvested and sensitized with a B-Env peptide pool (158 peptide pool of Clade B Env protein). For controls, Ebola glycoprotein peptide pool (22 peptides) or unstimulated cells served as a negative controls, and PMA was used as the positive control. Six hours later, the cells were fixed, stained with monoclonal antibodies, and analyzed by FACS to detect the IFN-γ and TNF-α positive cells in the CD4 (left panel, 9A-1) and CD8 (right panel, 9A-2) positive populations. The symbols depict the individual results for the ten mice in each group. The thin horizontal bar represents the average of the ten data points with a standard deviation error bar. B (B-1, B-2, B-3). Sera from the three groups of animals were collected 10 days after the third immunization, and ELISA was performed to detect the antibody against the respective clade Env's as described in Materials and Methods section of PART II. Mouse sera from different groups were diluted from 1:200 to 1:800 for testing. Each bar represents the average OD reading from the three mice per group.

FIG. 10 (A-1, A-2, A-3, B-1, B-2, C-1, C-2, C-3). CD8+ T cell responses to different clade and gene combination vaccine candidates by intracellular cytokine analysis. Three groups of mice were immunized with a control vector (VR1012), ABC (×4) or ABC (×6) as described in Table 1. Ten days after the final immunization, splenic cells were harvested and sensitized with the following peptide pools: A-Gag (125 peptides), B-Gag (122 peptides), C-Gag (105 peptides), A-Env (154 peptides), B-Env (158 peptides), C-Env (154 peptides), B-Pol-1 (120 peptides from the first half of Clade B Pol), or B-Pol-2 (128 peptides from the second half of clade B Pol). Cells were stimulated and analyzed by FACS, with positive and negative controls as in the legend to FIG. 9 to detect the IFN-γ and TNF-α positive cells in the CD8+ population. The symbols show the individual results for the ten mice in each group. The thin horizontal bar is the average of the ten data points with standard deviation bars.

Figure 11A:
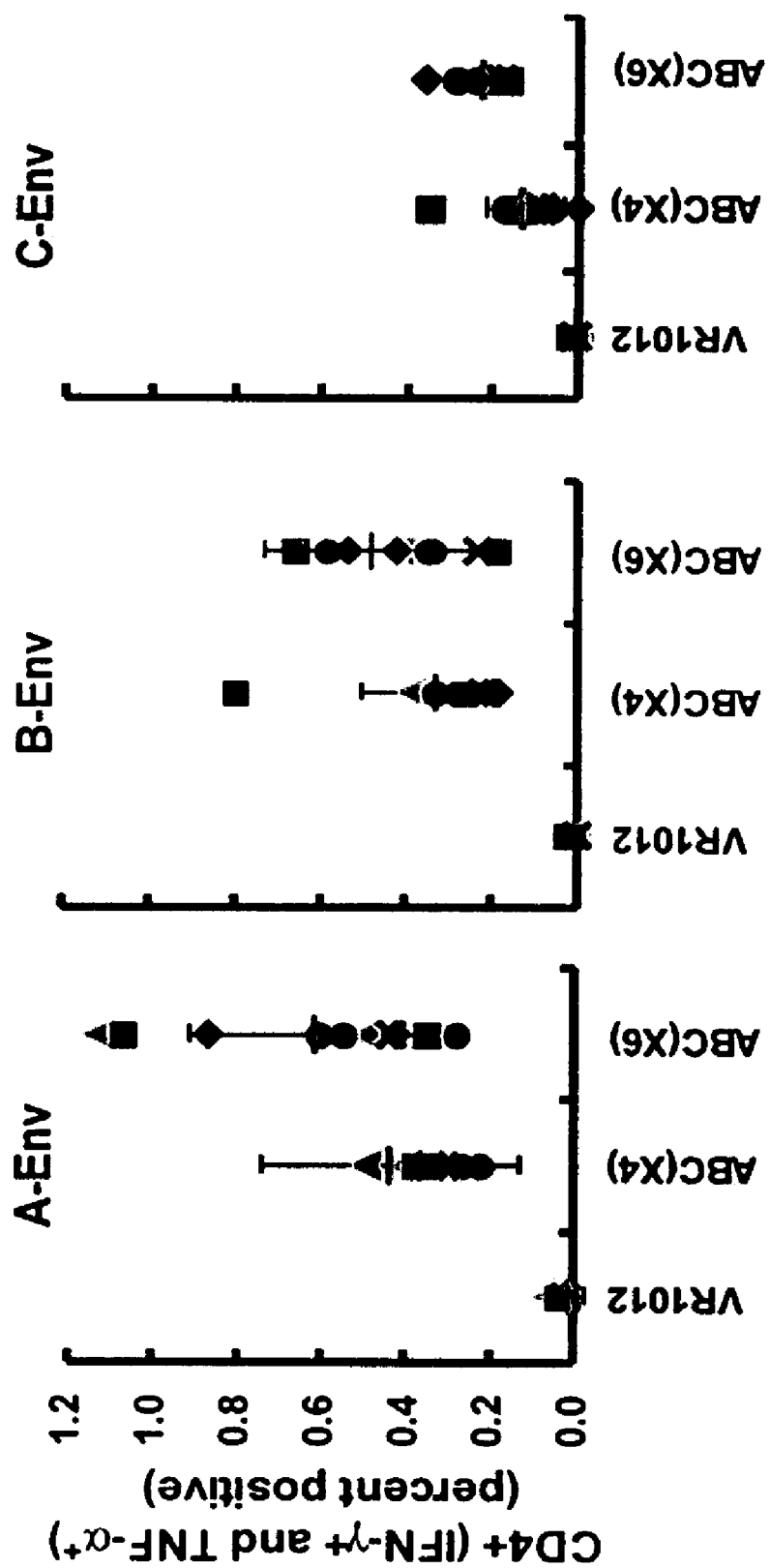

FIG. 11. CD4+ T cell and antibody responses to combination gene and clade vaccine candidates by intracellular flow cytometry and ELISA. Three groups of mice were immunized with the indicated control or combination vaccines as shown in Table 1. (A). Ten days after the final immunization, splenic cells were harvested and sensitized with the indicated peptide pools as described in the legend to FIG. 9. Individual responses are shown with the symbols, and the thin horizontal bar depicts the average of the ten data points with a standard deviation error bar. B (B-1, B-2, B-3). Sera from the three groups of animals were collected 10 days after the third immunization, and ELISA was performed to detect the antibody against envelope as described in Materials and Methods section of PART II. Mouse sera from different groups were diluted starting from 1:100 to 1:2,700 for testing. Each bar represents the average OD reading from the ten mice per group.

Figure 12A:
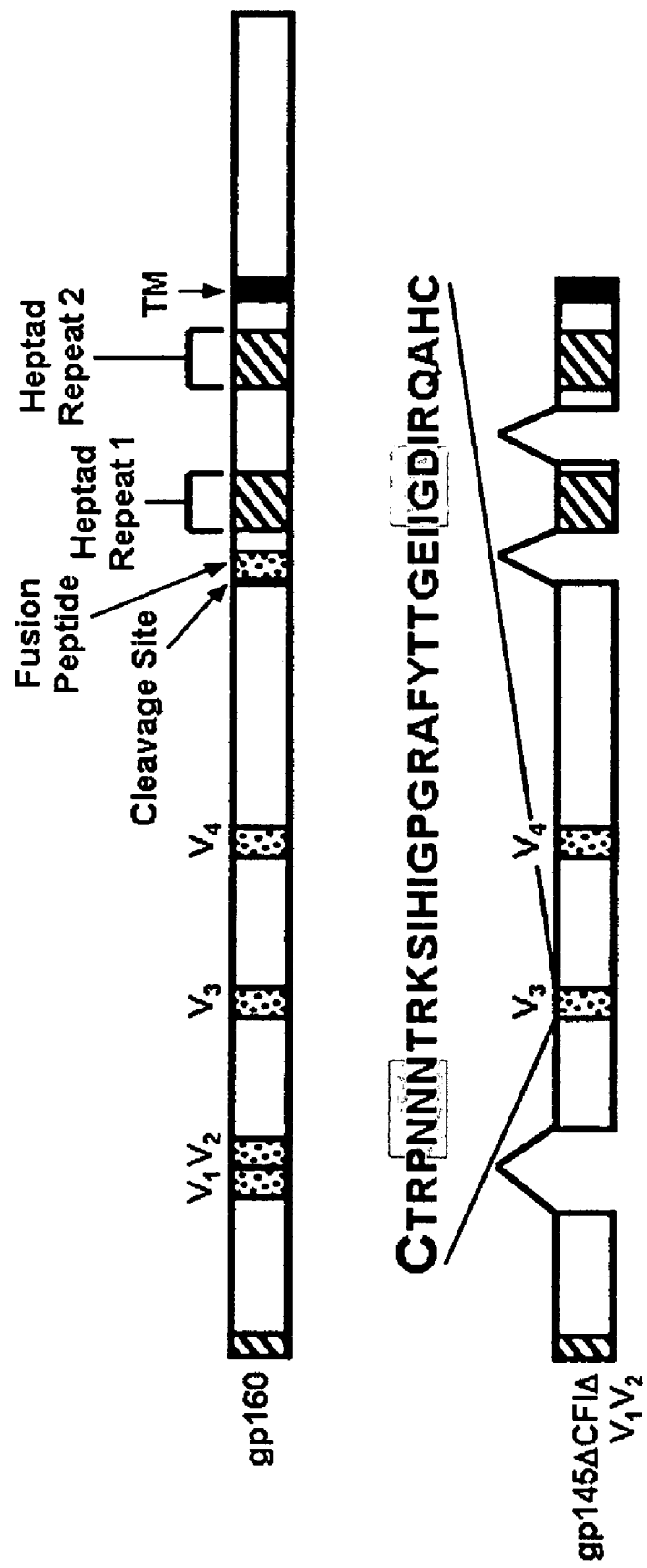
Figure 12B:
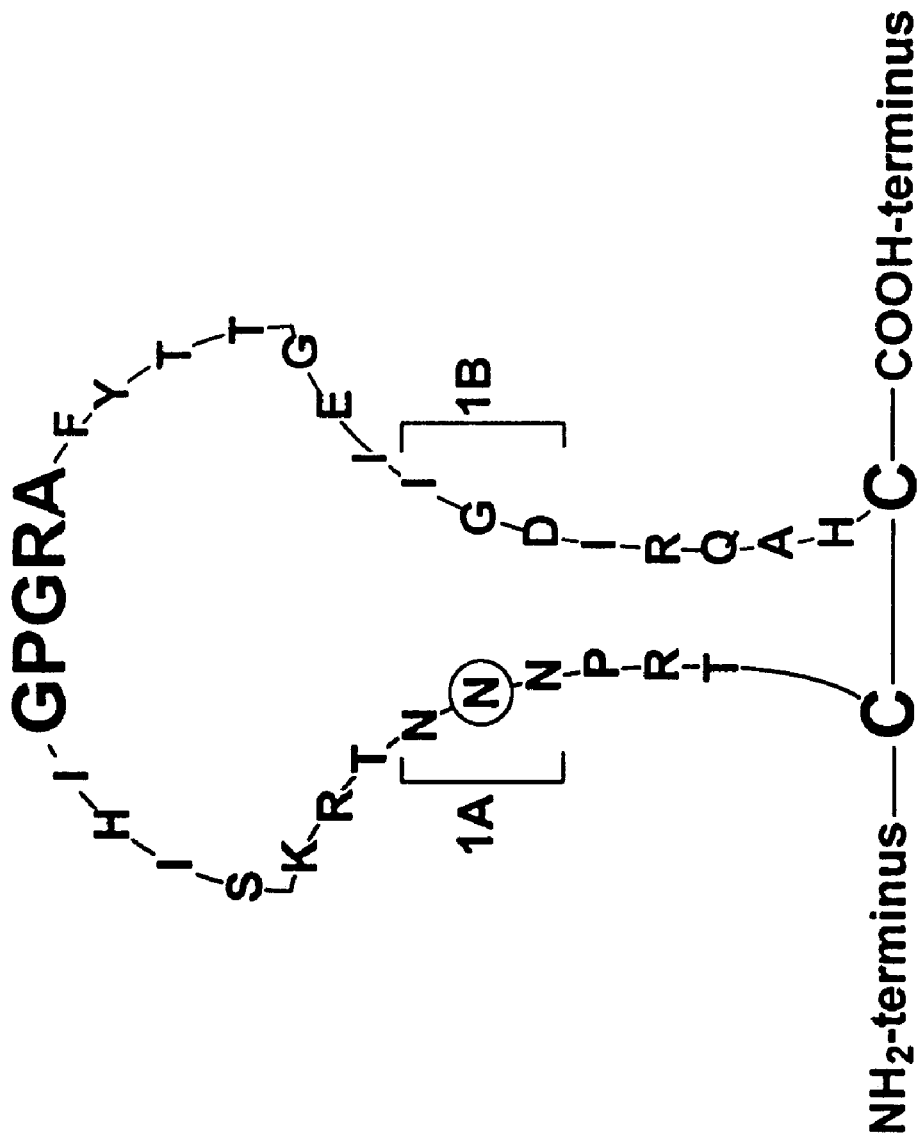

FIG. 12. Schematic representation of Envelope mutations. A. The major structural motifs in HIV Env are shown, together with the selected expression vectors used in these studies. V1, V2, V3, and V4 indicate the respective variable regions and the sequence of the relevant V3 loops are indicated (SEQ ID NO: 1). B. Schematic structure of the V3 loop and V3 (1AB) stem-shortening mutations are indicated (SEQ ID NO: 1).

FIG. 13. Mutation in the stem of the V3 loop and protein expression of various gp 145ΔCFI (HXB2/BaL chimera) V3 deletion mutants. A. Sequences of progressive V3 stem deletion mutations in Env from HXB2/BaL chimera. B. Protein expression of gp145ΔCFI (HXB2/BaL chimera) V3 deletion mutant expression vectors. The indicated mutations in the gp145ΔCFI constructs, described previously (Chakrabarti, B. K. et al. 2002 J Virol 76:5357-5368), were prepared and analyzed by SDS-PAGE followed by Western blot analysis with human monoclonal antibody 2F5. Plasmid expression vectors encoding the indicated mutants were transfected into 293 cells by use of calcium phosphate. Cell lysates were collected 48 hours later. C. Expression of gp145 (HXB2/BaL chimera) V3 deletion mutant vectors with the V1 and V2 regions deleted.

FIG. 14. Effects of mutations in the stem of the V3 loop on tropism of the 89.6P Env. A, B (B-1, B-2, B-3, B-4, B-5, B-6, B-7). Buoyant density sedimentation analysis of indicated V3 mutants in lentiviral vector particles, performed as described in Materials and Methods section of PART III. C(C-1, C-2). Effects of V3 mutations in strain 89.6P Env on infection of a CXCR4-tropic cell line, MT-2 (left), and a CCR-5 tropic indicator cell line, MAGI-CCR5 (right), using a liciferase reporter gene. The positions of the indicated V3 mutations in strain 89.6P Env are the same as shown for the HXB2/BaL chimera (FIG. 13A). Both codon-modified and wild-type (wt) 89.6P Envs were used as positive controls.

FIG. 15. Expression of different HIV gp145 (HXB2/BaL chimera) V region mutants and induction of neutralizing antibodies. A. Expression of the indicated HXB2/Bal V region mutants was determined by SDS-PAGE followed by Western blotting in transfected 293 cells. B. Neutralizing activity against BaL in sera from guinea pigs immunized with the indicated DNA/ADV expression vectors. Sera were tested at 1:5 dilution. Results are the mean (+/−SD) for four guinea pig sera for each construct. The P value shown is the result of a Mann-Whitney test comparing the medium neutralization value of the two groups indicated.

FIG. 16. Characterization of antibody response induced by gp145 (HXB2/BaL chimera) ΔV1V2 and selected V3 region mutants. A. Neutralization activity against BaL induced by immunization of guinea pigs with the indicated mutants, including the ΔV1V2 deletion mutants and the ΔV1V2V3 (1AB) stem-shortening mutants. Sera were tested at 1:5 dilution. Results are the means (+/−SD) for four guinea pig sera for each construct. Results from one of two independent experiments are shown. The sera tested were independent from the sera tested for FIG. 15B. B. Total ELISA titers in the same guinea pig sera are shown and are comparable between the different mutants.

FIG. 17. Comparison of breadth and potency of the antibody response induced by selected V region mutants. A (A-1, A-2, A-3, A-4). $IC_{50}$ titers against four clade B primary isolates are indicated (see Materials and Methods section in PART III). Results are the means±standard errors of four guinea pig sera for each construct. The statistically significant differences between ΔV1V2V3(1AB) and either the wild-type gp140/145 or gp140/145ΔCFI are shown (Mann-Whitney test). B. Four individual sera from ΔV1V2V3(1AB) immunized guinea pigs were screened against a panel of 10 primary viruses. Sera were tested at a 1:5 dilution. Percentages of neutralization (compared with corresponding pre-immune sera) are indicated. Data shown are an average of two experiments.

FIG. 18. In vitro expression of HXB2/Bal and 89.6P Env by both plasmids and rADV vaccine constructs. The plasmid Env [gp145ΔCFI(R5) and gp145ΔCFI(89.6P)] and rADV [ADV-gp140ΔCFI(R5) and ADV-gp140ΔCFI(89.6P)] vaccine constructs were expressed in vitro, and protein expression was assessed by Western blotting with human anti-HIV IgG.

FIG. 19 (A-D). Vaccine-elicited PBMC IFN-γ ELISPOT responses to SIVmac Gag-Pol-Nef and HIV-1 Env. Freshly isolated PBMCs were assessed for IFN-γ ELISPOT responses after in vitro exposure to peptide pools spanning the SIVmac Gag-Pol-Nef and HIV-1 Env proteins. All Env-specific responses were assessed by using peptides that were matched to the Env immunogen. The terms “matched” and “mismatched” refer to the relationship between the Env immunogen and the challenge virus. Arrows indicate time of inoculation with either DNA or rADV immunogens. Data are presented as the total antigen-specific SFC responses to Gag-Pol-Nef and HIV-1 Env per $10^6$ PBMCs and represent the mean values for six monkeys±standard error.

FIGS. 20 A and B. Vaccine-elicited PBMC IFN-γ ELISPOT responses to individual viral proteins assessed 2 weeks following rADV boosting. ELISPOT responses to SIVmac239 Gag and Pol and HIV-1 Env antigens were assessed. Env-specific responses were assessed with peptides that were matched to the Env immunogen, and mock Env-vaccinated monkeys were assayed with 89.6P peptide pools. ELISPOT assays were performed on whole PBMCs (A) or PBMCs depleted of $CD8^+$ T lymphocytes (B). Data are presented as the mean SFC responses to individual viral proteins per $10^6$ PBMCs and represent the mean values for six experimentally vaccinated monkeys±standard error.

FIG. 21. Postchallenge peripheral blood $CD4^+$ T-lymphocyte counts. These values represent the mean percentage of $CD3^+$ $CD4^+$ lymphocytes assessed prospectively on all experimental monkeys through day 168 postchallenge.

FIG. 22. Postchallenge plasma viral RNA levels. These values were determined by an ultrasensitive bDNA amplification assay with a detection limit of 50 copies/ml. The values plotted represent the geometric mean±standard error at each sampling time for each experimental group of monkeys.

FIG. 23 (A-D). Plasma SHIV-89.6P neutralization titers determined from plasma samples obtained from the monkeys following SHIV-89.6P challenge. Neutralization was determined with an MT-2 dye exclusion assay.

FIG. 24 (A-C). 89.6P Env-specific PBMC IFN-γ ELISPOT responses assessed 1 week following rADV boost and both 3 and 10 weeks following SHIV-89.6P challenge. ELISPOT responses were determined after in vitro exposure of PBMCs (peripheral blood lymphocytes, PBL) to peptide pools spanning the HIV-1 89.6P Env protein. The bars represent the mean values for six monkeys with the standard error shown.

FIGS. 25 A, B and C. Vaccine-elicited cellular immune responses to HIV-1 clade A, clade B, clade C, and 89.6P Env antigens by PBL of rhesus monkeys following DNA prime and rAd boost immunizations. PBL were freshly isolated at weeks 12 (post-DNA prime) (A), 27 (post-rAd boost) (B) and 42 (day of challenge) (C) post-immunization and assessed for IFN-γ ELISPOT responses following stimulation with peptide pools spanning the indicated HIV-1 Env proteins. Data are presented as the mean number of antigen-specific spot forming cells (SFC) per $10^6$ PBL +/−SEM from 6 monkeys per group.

Figure 26:
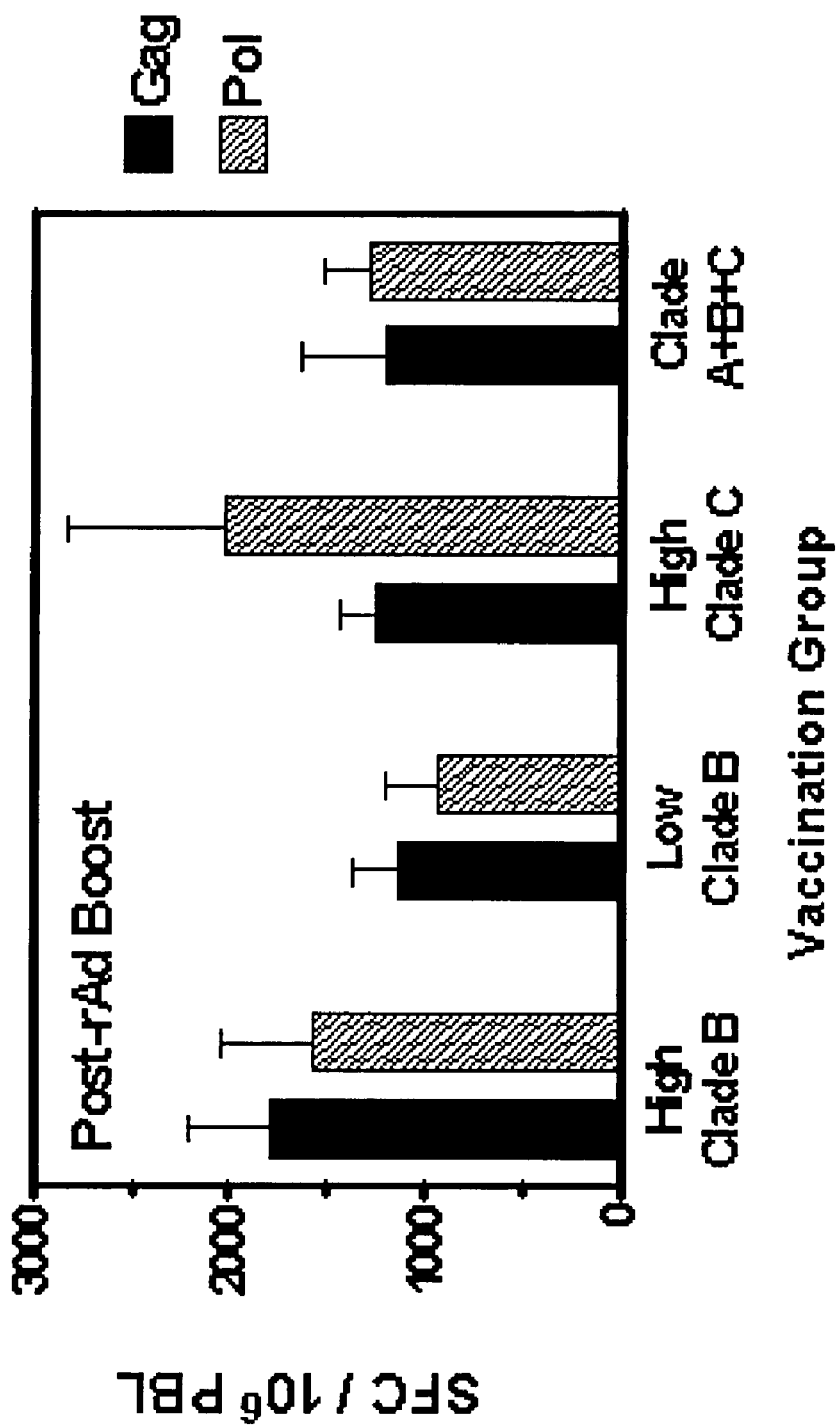

FIG. 26. Vaccine-elicited cellular immune responses to SIV Gag and Pol by PBL of rhesus monkeys following DNA prime/rAd boost immunizations. PBL were freshly isolated at week 27 post-immunization (1 week following rAd boost) and assessed for IFN-γ ELISPOT responses following stimulation with peptide pools spanning the SIV Gag and Pol proteins. Data are presented as the mean number of antigen-specific spot forming cells (SFC) per $10^6$ PBL +/−SEM from 6 monkeys per group.

Figure 27:
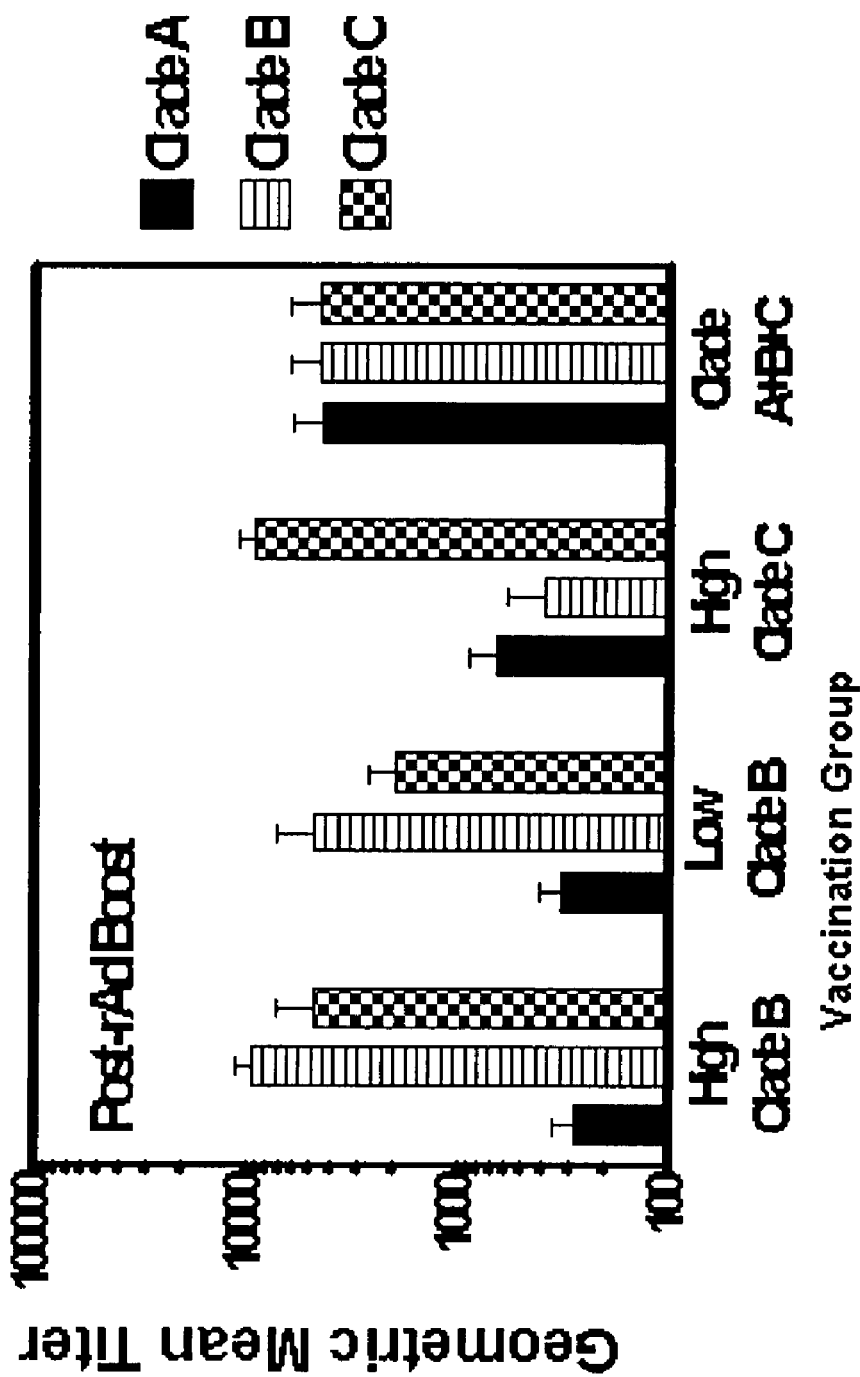

FIG. 27. Antibody titers to HIV-1 clade A, clade B, or clade C Env proteins in plasma from rhesus monkeys following DNA prime/rAd boost immunizations. Plasma samples were obtained at week 28 post-immunization (2 weeks following rAd boost) and anti-gp145 antibody titers to the indicated HIV-1 Env proteins were determined by ELISA. Data are presented as the mean geometric titer from 6 monkeys per group.

Figure 28A:
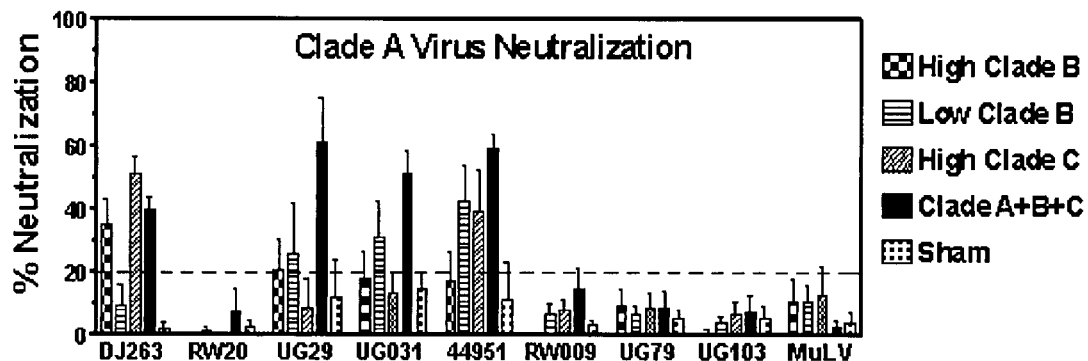
Figure 28B:
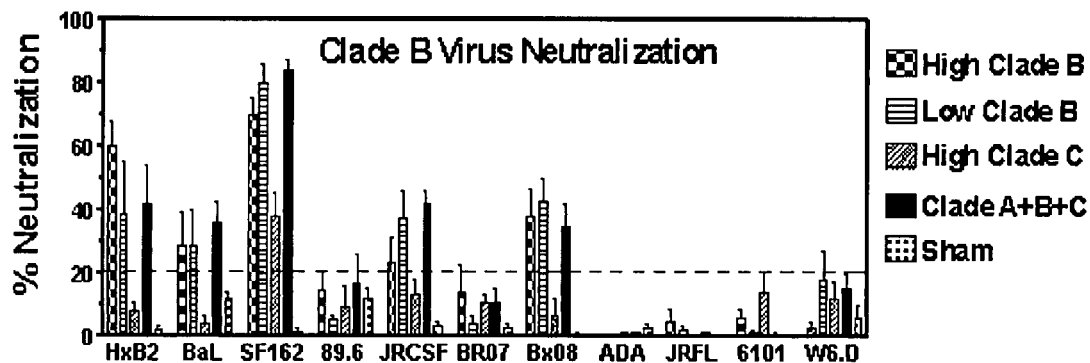
Figure 28C:
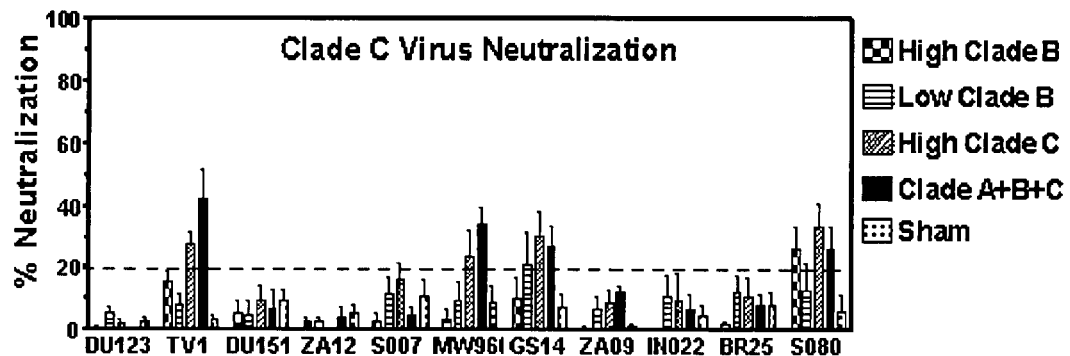

FIGS. 28 A, B and C. Antibody neutralizing activity in plasma of rhesus monkeys following DNA prime/rAd boost immunizations. Plasma samples were obtained from vaccinated and control monkeys at week 28 post-immunization (2 weeks following rAd boost), and tested for neutralizing activity against panels of clade A, clade B, and clade C HIV-1 isolates. The dashed line represents a reference point of 20% neutralization, as noted in the results section. Data are presented as the mean percent neutralizing activity +/−SEM from 6 monkeys per group. Note that the top panel of clade A viruses also includes a control MuLV Env pseudovirus.

Figure 29A:
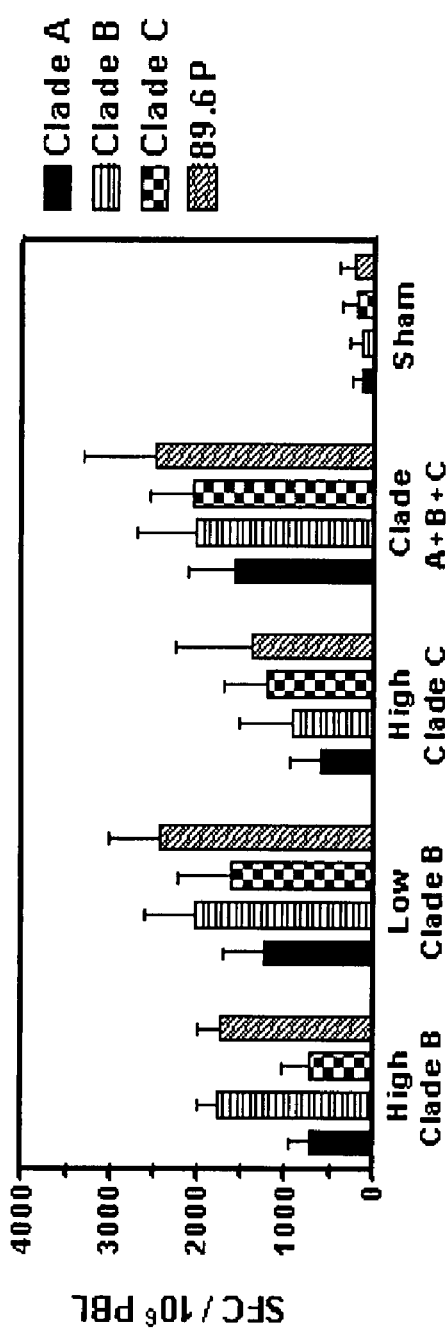
Figure 29B:
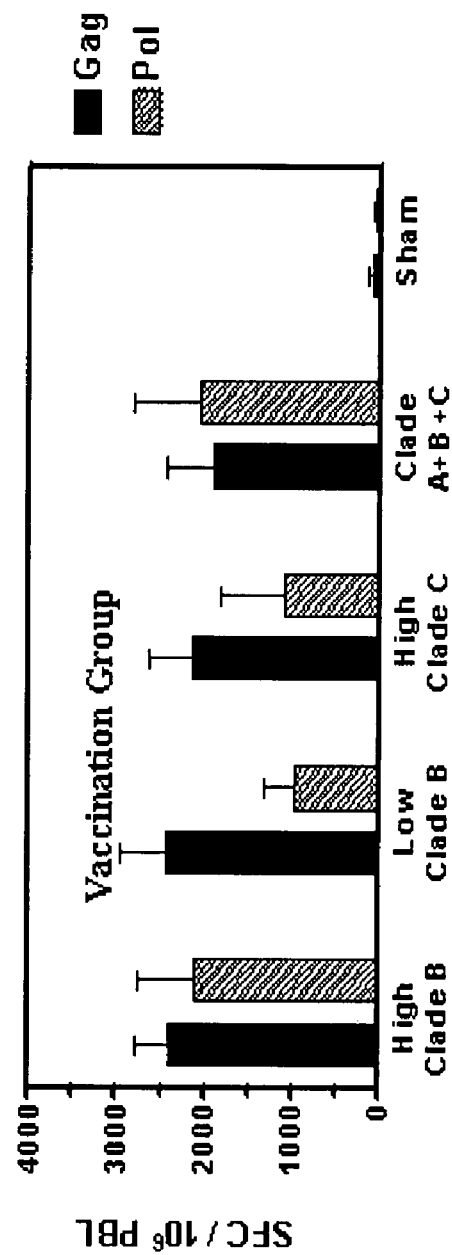

FIGS. 29 A and B. Cellular immune responses to HIV-1 Env and SIV Gag and Pol by PBL of vaccinated and control rhesus monkeys following SHIV-89.6P challenge. PBL were freshly isolated two weeks following challenge and assessed for IFN-γ ELISPOT responses following stimulation with peptide pools spanning the indicated HIV-1 Env proteins (A) or the SIV Gag and Pol (B) proteins. Data are presented as the mean number of antigen-specific spot forming cells (SFC) per $10^6$ PBL +/−SEM from 6 monkeys per group.

FIGS. 30 A and B. Plasma viral RNA levels following SHIV-89.6P challenge. The peak plasma viral RNA level (A) for each monkey was measured on day 16 post-challenge. The set point plasma viral RNA level (B) for each monkey was calculated as the median of values detected between days 85 and 169 post-challenge. Log viral copies/ml from individual monkeys are indicated, with bars indicating the median value of the 6 monkeys per experimental group. The detection limit of the assay, 125 copies/ml, is shown with a dashed line.

Figure 31:
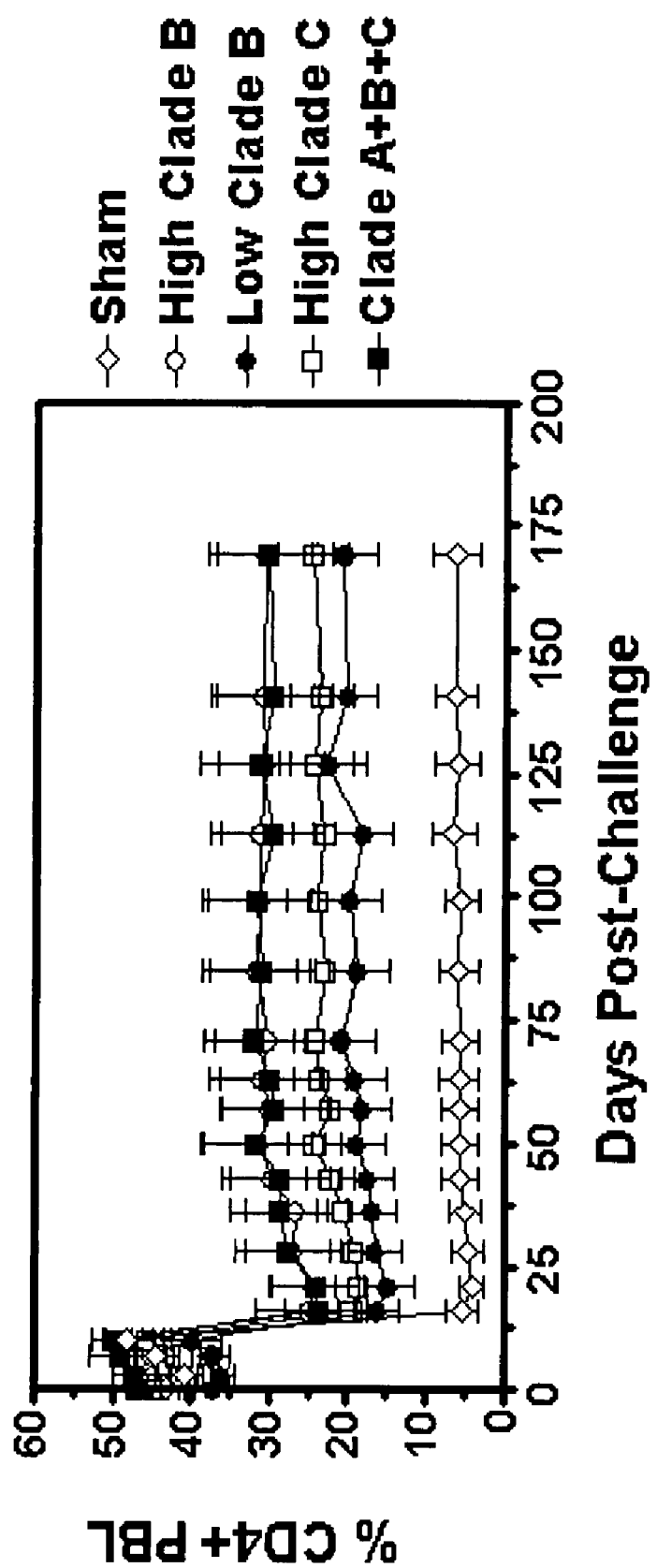

FIG. 31. Peripheral blood CD4$^+$ T lymphocytes post-SHIV-89.6P challenge. The percentage of CD3$^+$CD4$^+$ T lymphocytes in the peripheral blood of the rhesus monkeys was assessed by flow cytometry through day 169 following SHIV-89.6P infection. Data are presented as the mean percent of peripheral blood CD4$^+$ T lymphocytes from 6 monkeys per group +/−SEM.

Figure 32:
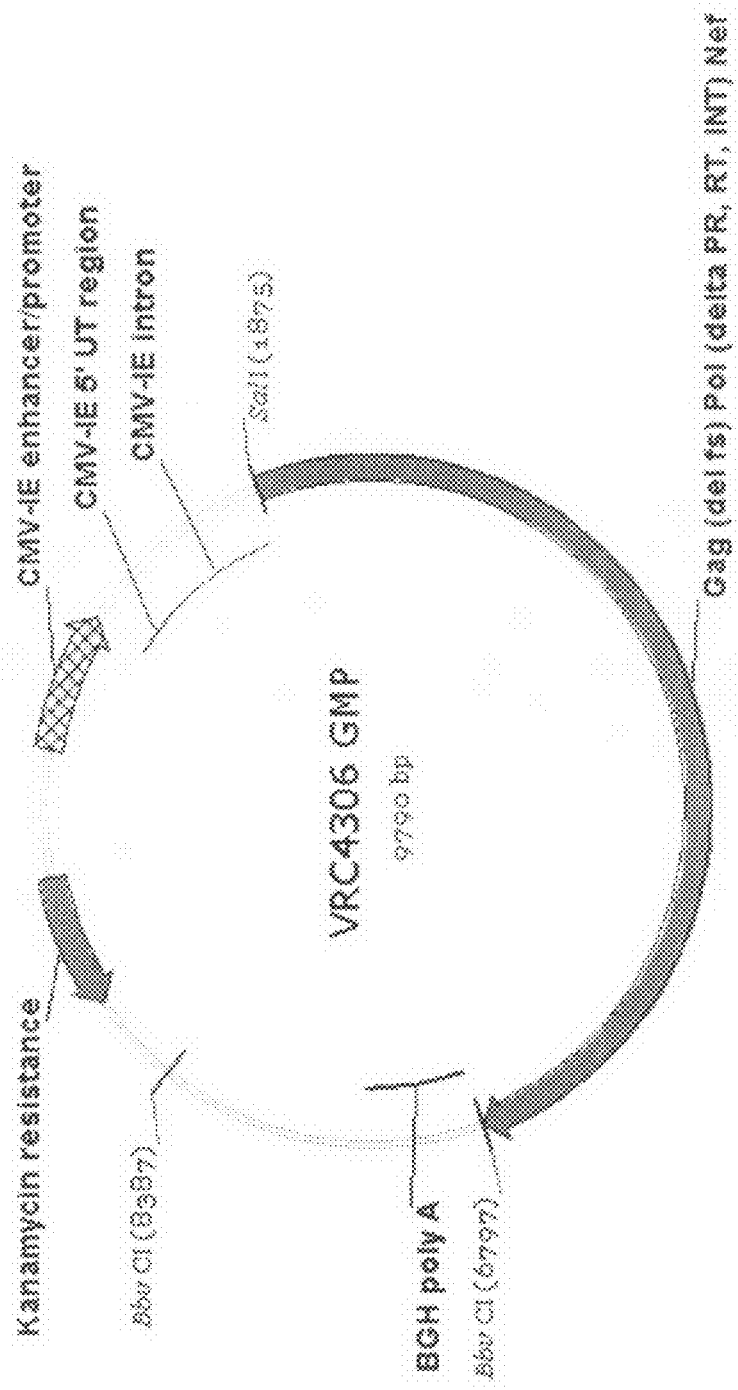

FIG. 32. VRC-4306 DNA construct. This plasmid DNA is designed to express the HIV-1 Gag, Pol, and Nef polyproteins with modifications to reduce potential toxicity (deletions in the regions which affect protease, RT and integrase) and increase expression in human cells, together with a strong, constitutive CMV promoter. It contains the gene for kanamycin resistance incorporated into the bacterial vector backbone as a selectable marker.

Figure 33:
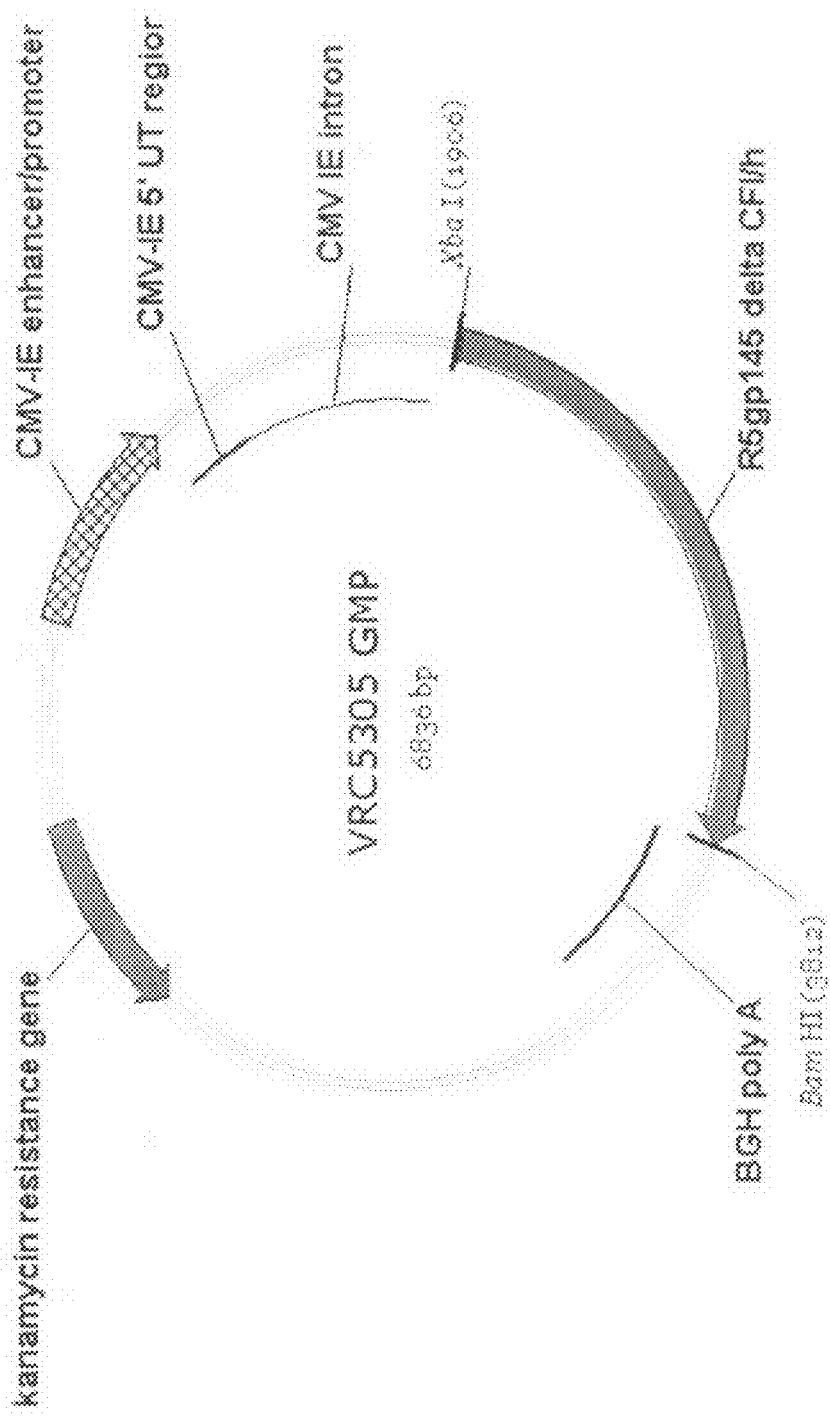

FIG. 33. VRC-5305 DNA Construct. This plasmid DNA is designed to express the HIV-1 Clade A Env protein with modifications to reduce potential toxicity (deletions of fusion and cleavage domains and the interspace between heptad (H) 1 and 2) and increase expression in human cells, together with a strong, constitutive CMV promoter. It contains the gene for kanamycin resistance incorporated into the bacterial vector backbone as a selectable marker.

Figure 34:
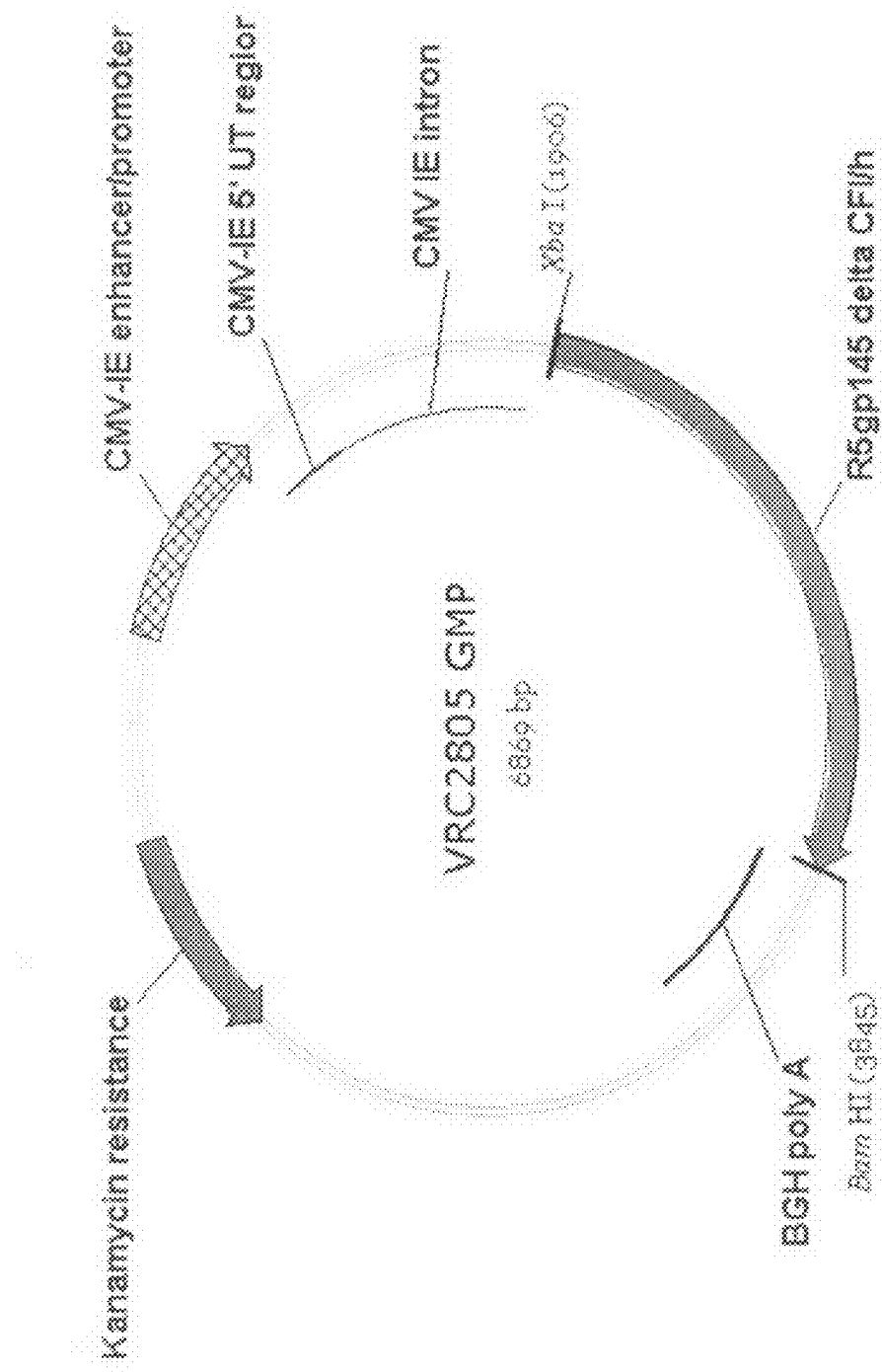

FIG. 34. VRC-2805 DNA Construct. This plasmid DNA is designed to express the HIV-1 clade B Env glycoprotein with modifications to reduce potential toxicity (deletions of fusion and cleavage domains and the interspace between heptad (H) 1 and 2) and increase expression in human cells, together with a strong, constitutive CMV promoter. It contains the gene for kanamycin resistance incorporated into the bacterial vector backbone as a selectable marker.

Figure 35:
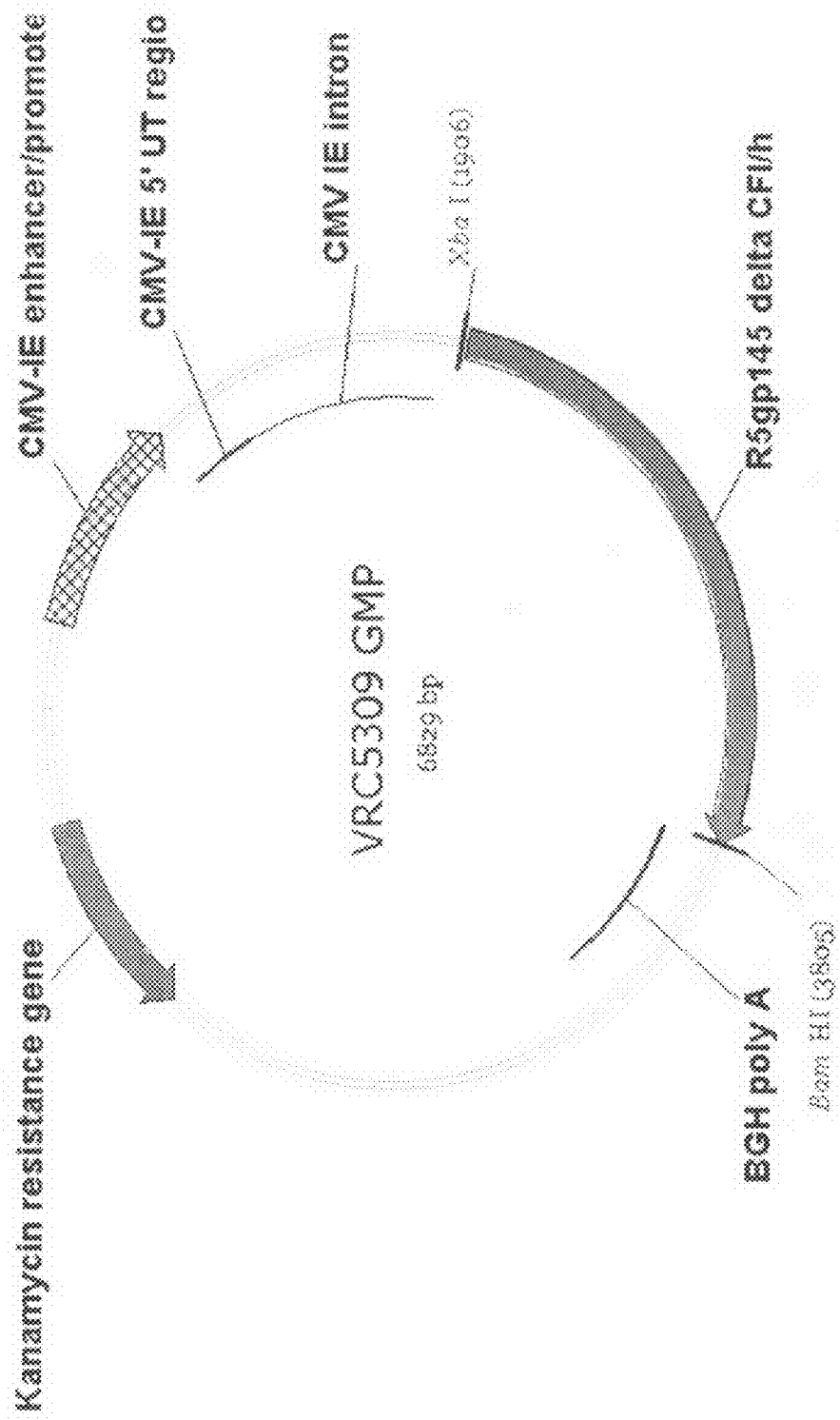

FIG. 35. VRC-5309 DNA Construct. This plasmid DNA is designed to express the HIV-1 Clade C Env glycoprotein with modifications to reduce potential toxicity (deletions of fusion and cleavage domains and the interspace between heptad (H) 1 and 2) and increase expression in human cells, together with a strong, constitutive CMV promoter. It contains the gene for kanamycin resistance incorporated into the bacterial vector backbone as a selectable marker.

Figure 36:
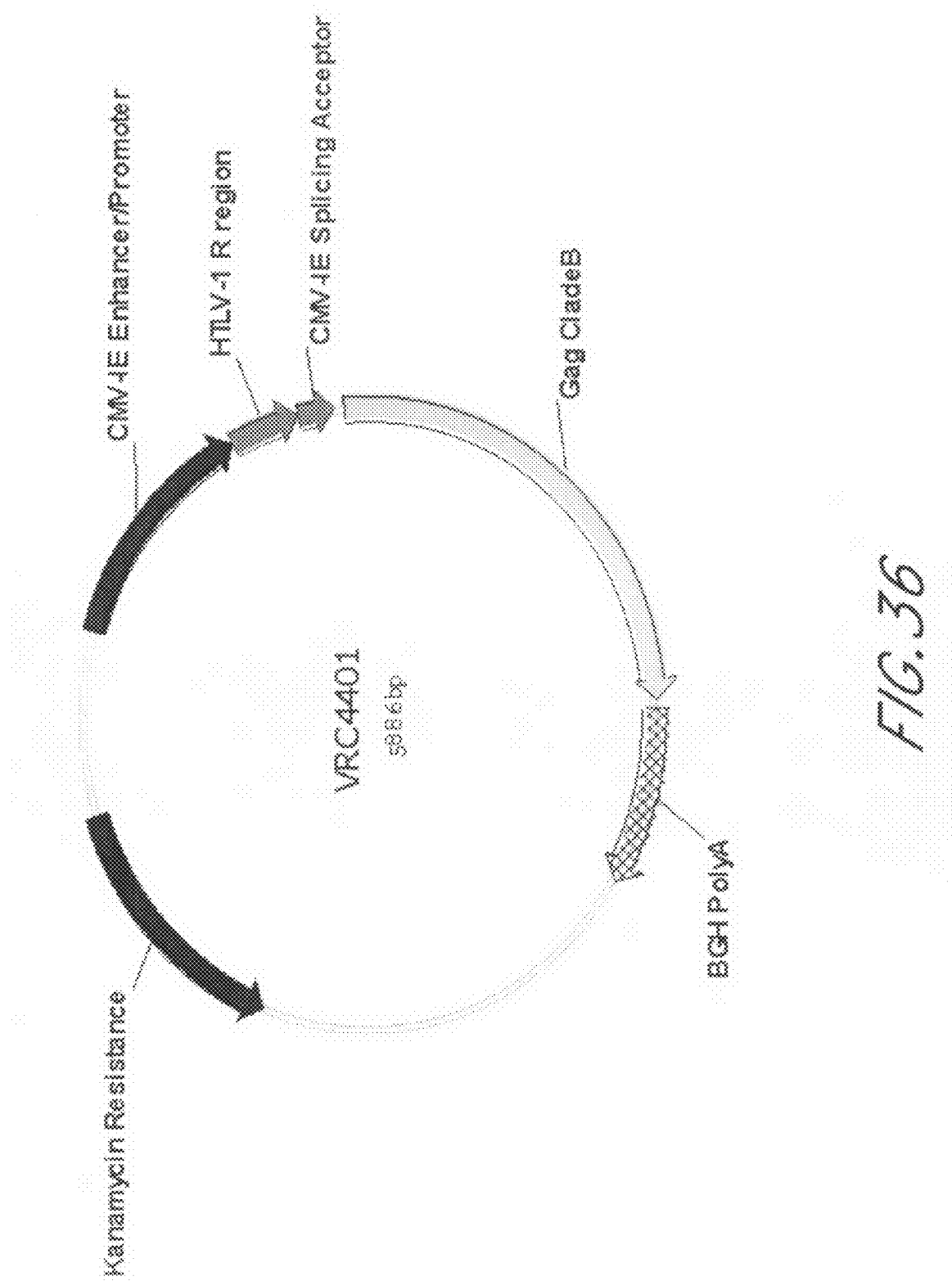

FIG. 36. Plasmid map for HIV-1 Clade B Gag (VRC-4401).

Figure 37:
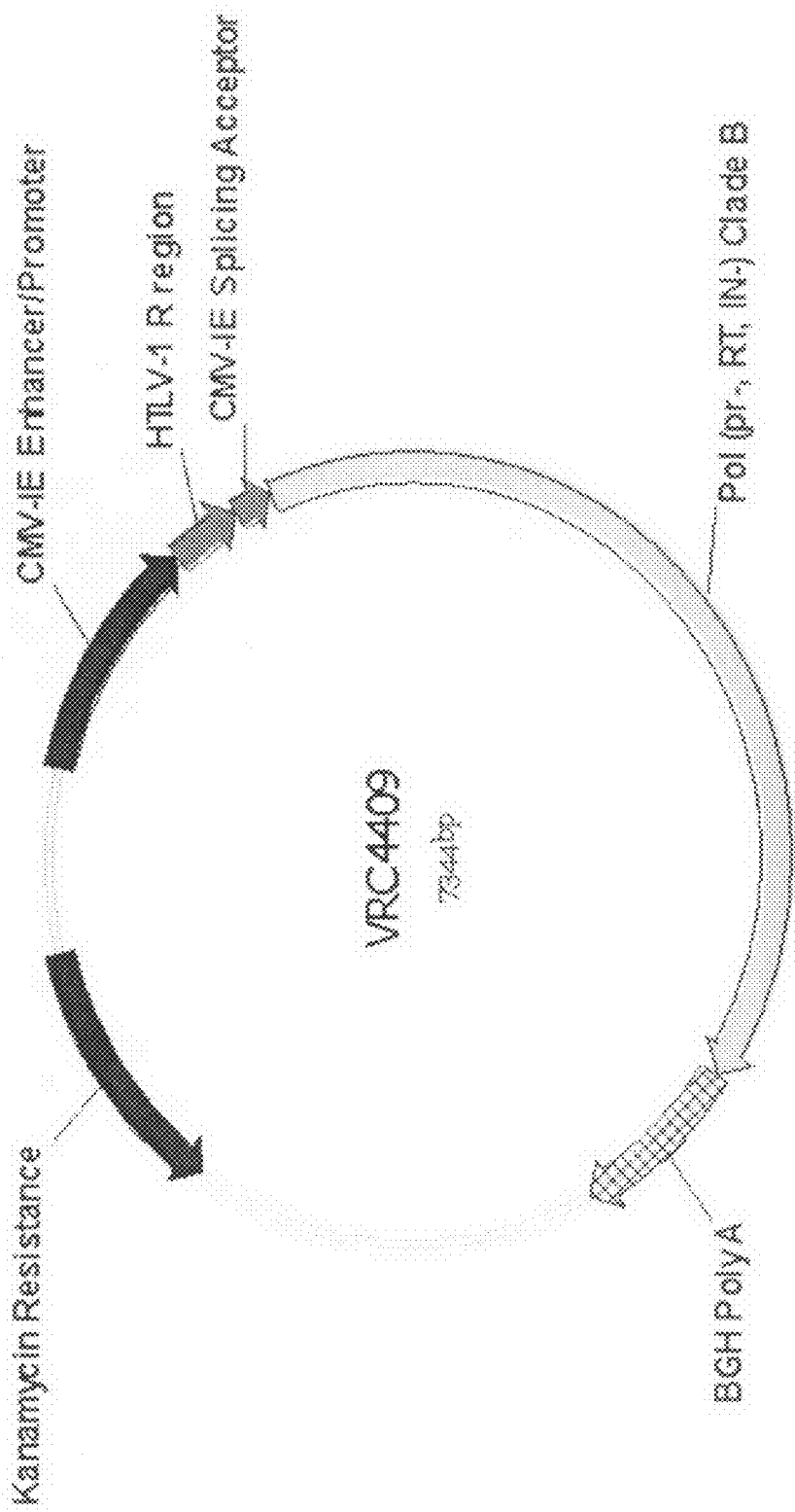

FIG. 37. Plasmid map for HIV-1 Clade B Pol (VRC-4409).

Figure 38:
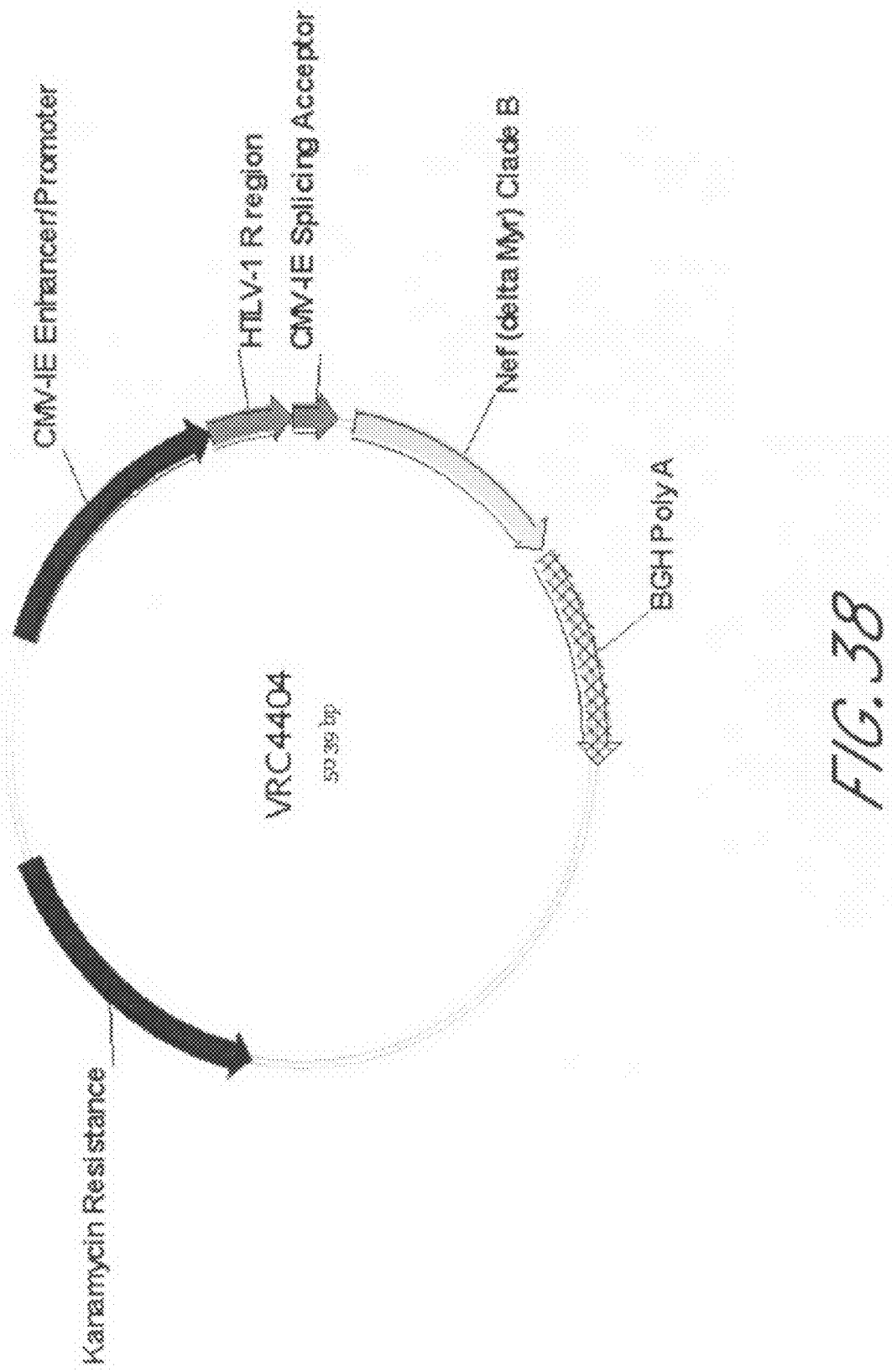

FIG. 38. Plasmid map for HIV-1 Clade B Nef (VRC-4404).

Figure 39:
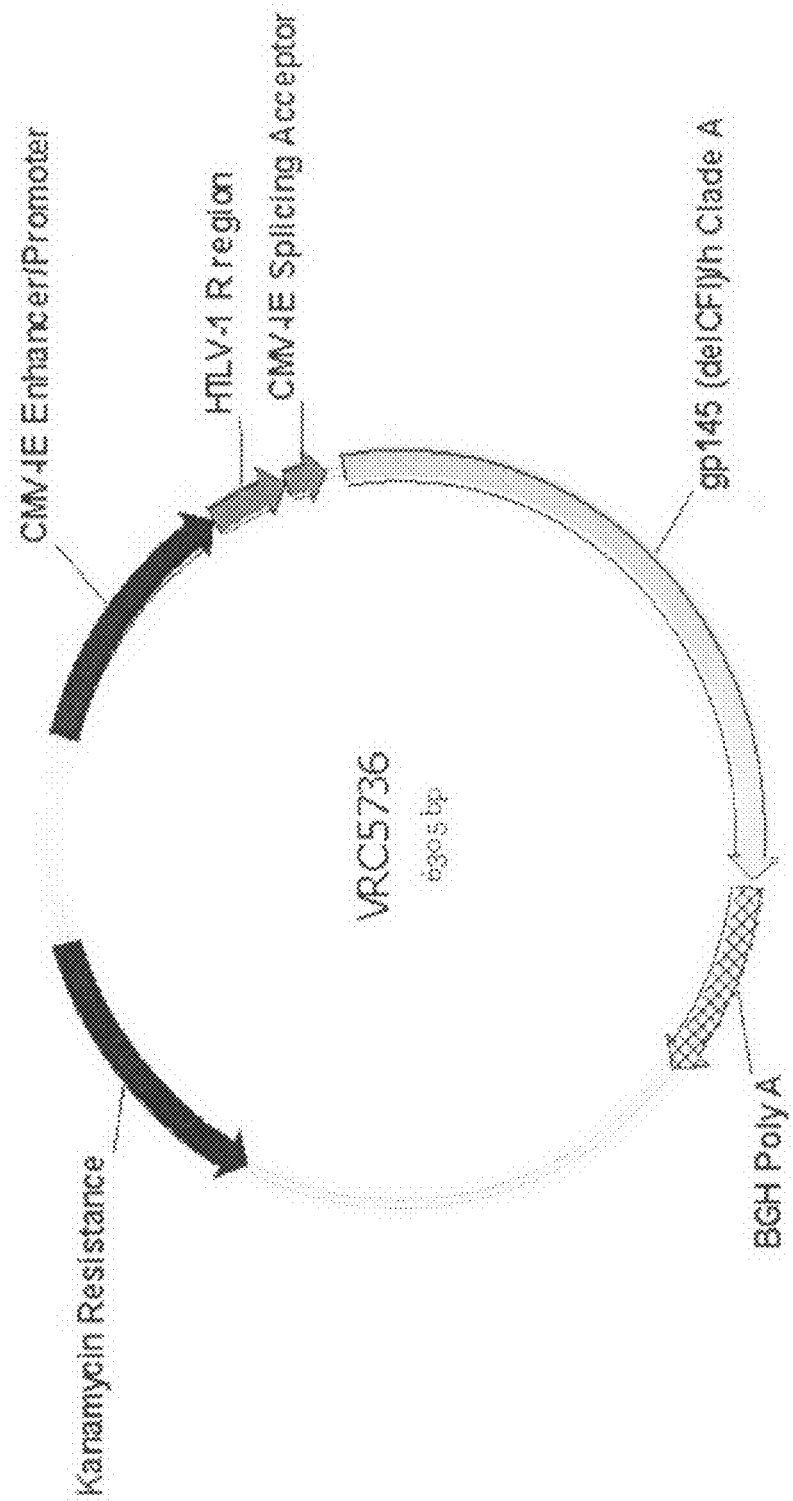

FIG. 39. Plasmid map for HIV-1 Clade A Env (VRC-5736).

Figure 40:
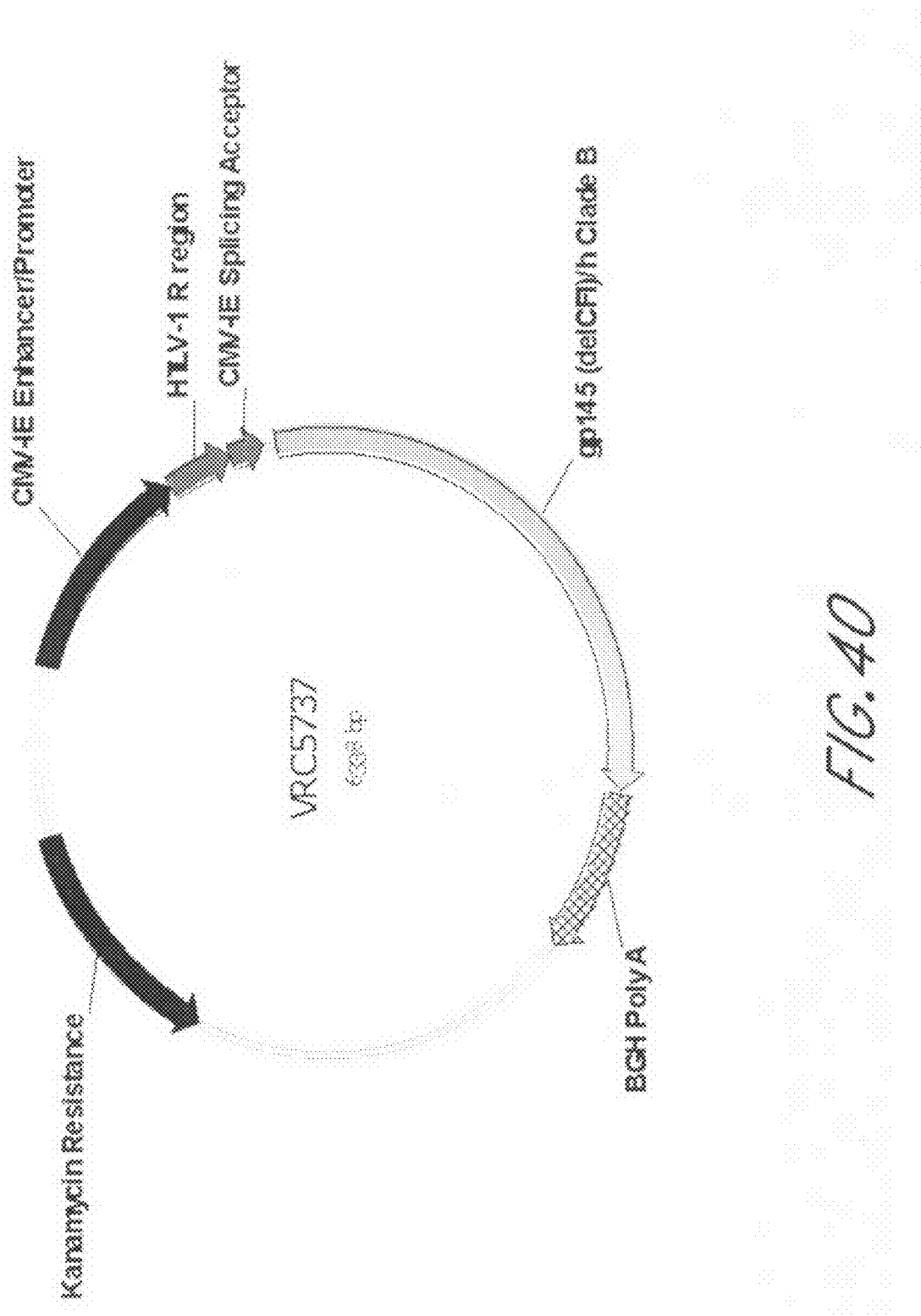

FIG. 40. Plasmid map for HIV-1 Clade B Env (VRC-5737).

Figure 41:
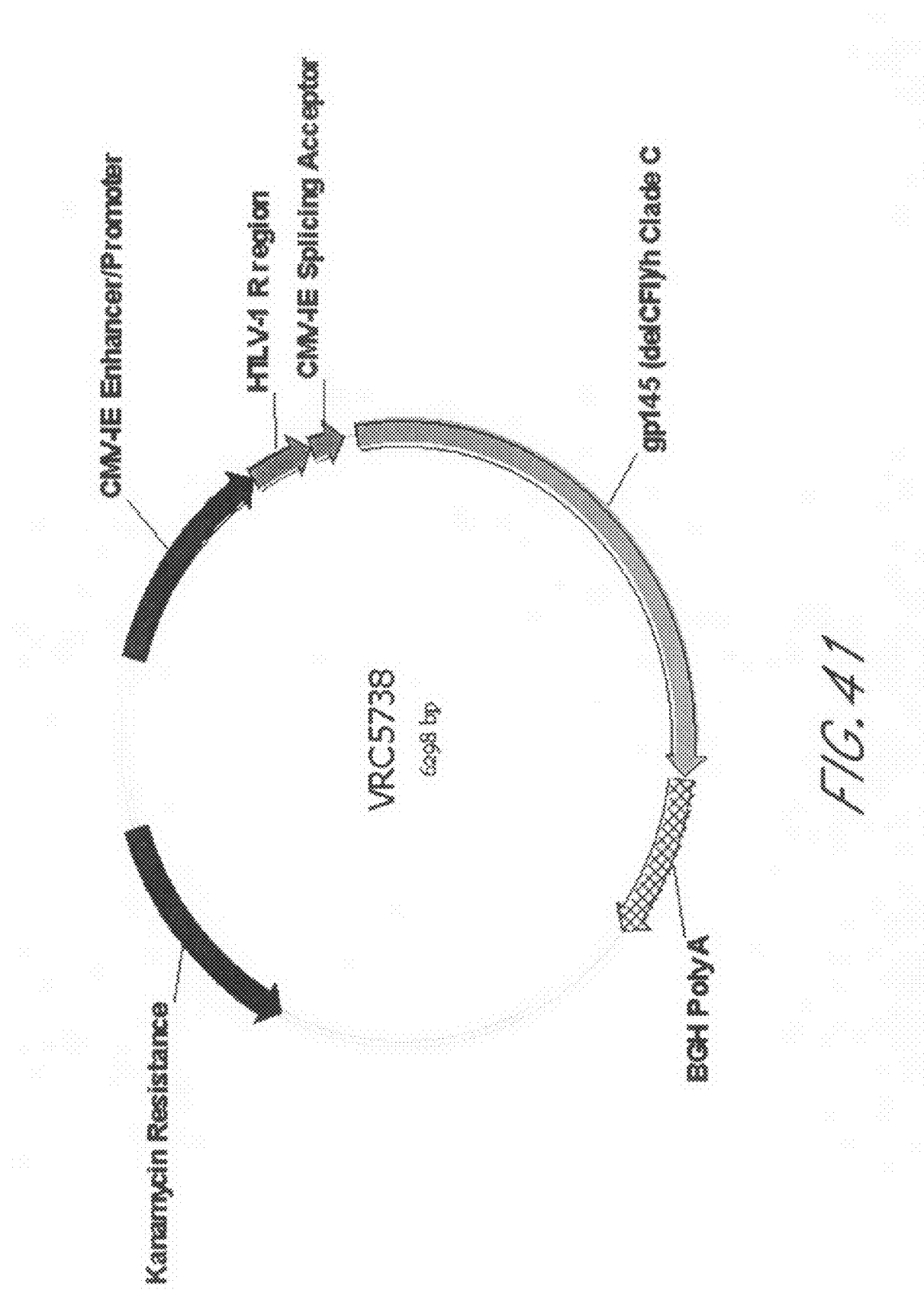

FIG. 41. Plasmid map for HIV-1 Clade C Env (VRC-5738).

Figure 42:
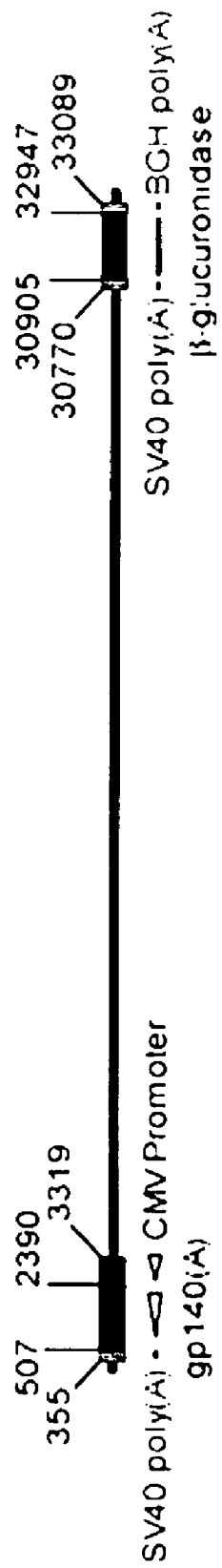

FIG. 42. Adgp 140(A).11D adenoviral vector map.

Figure 43:
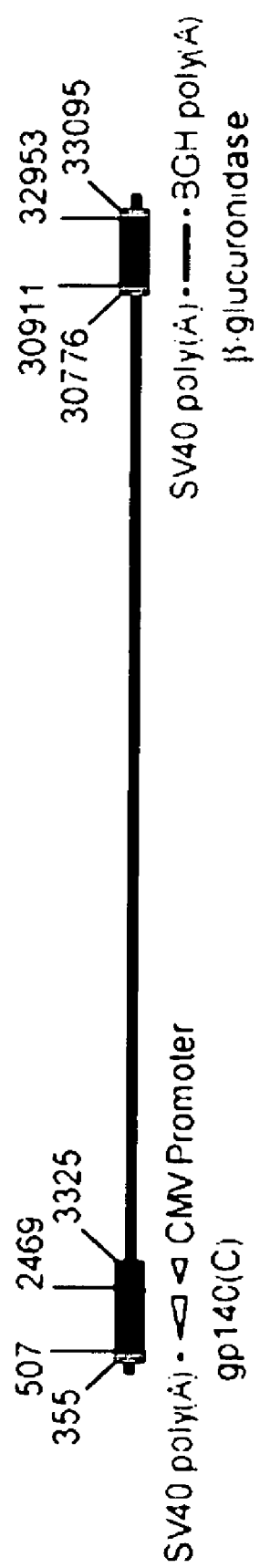

FIG. 43. Adgp 140(C).11D adenoviral vector map.

Figure 44:
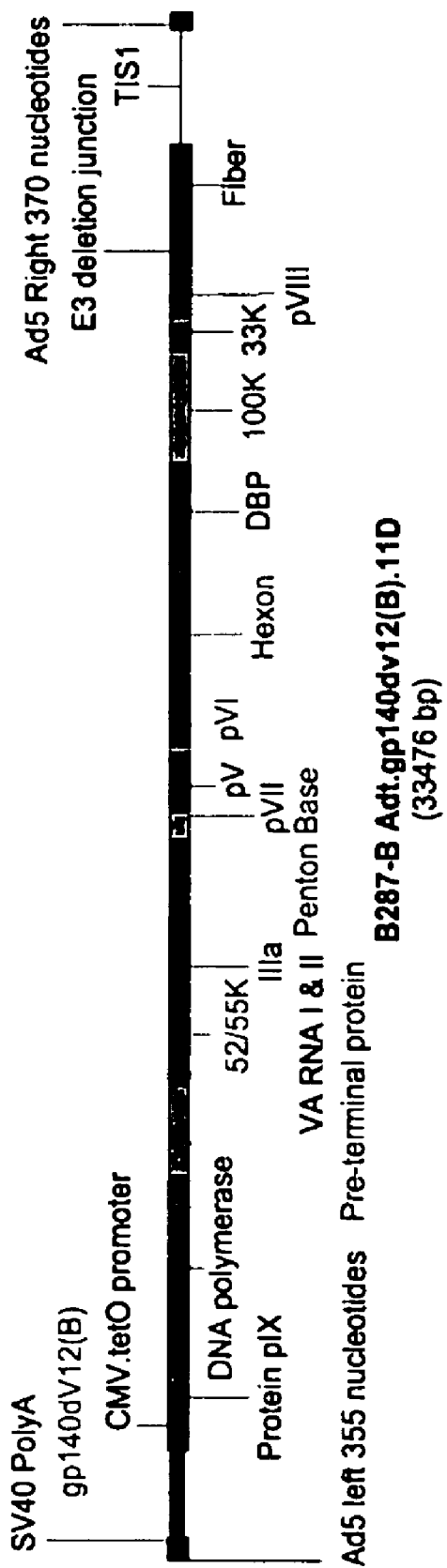

FIG. 44. B287-B Adt.gp140dv12(B).11D adenoviral vector map.

Figure 45:
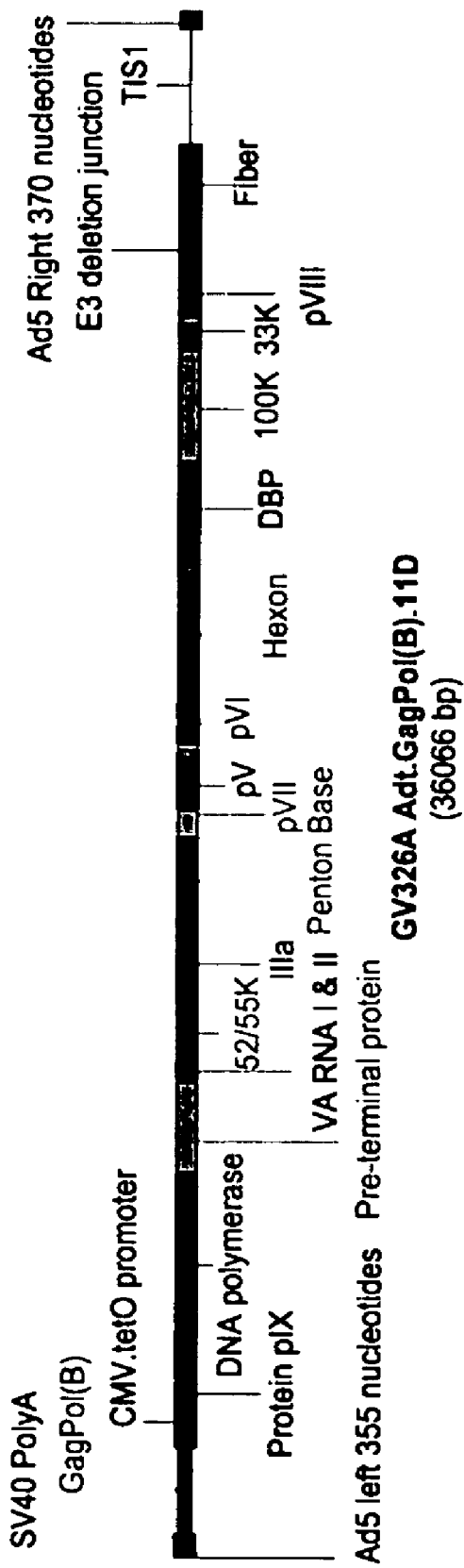

FIG. 45. GV326A Adt.GagPol(B).1 ID adenoviral vector map.

Figure 46:
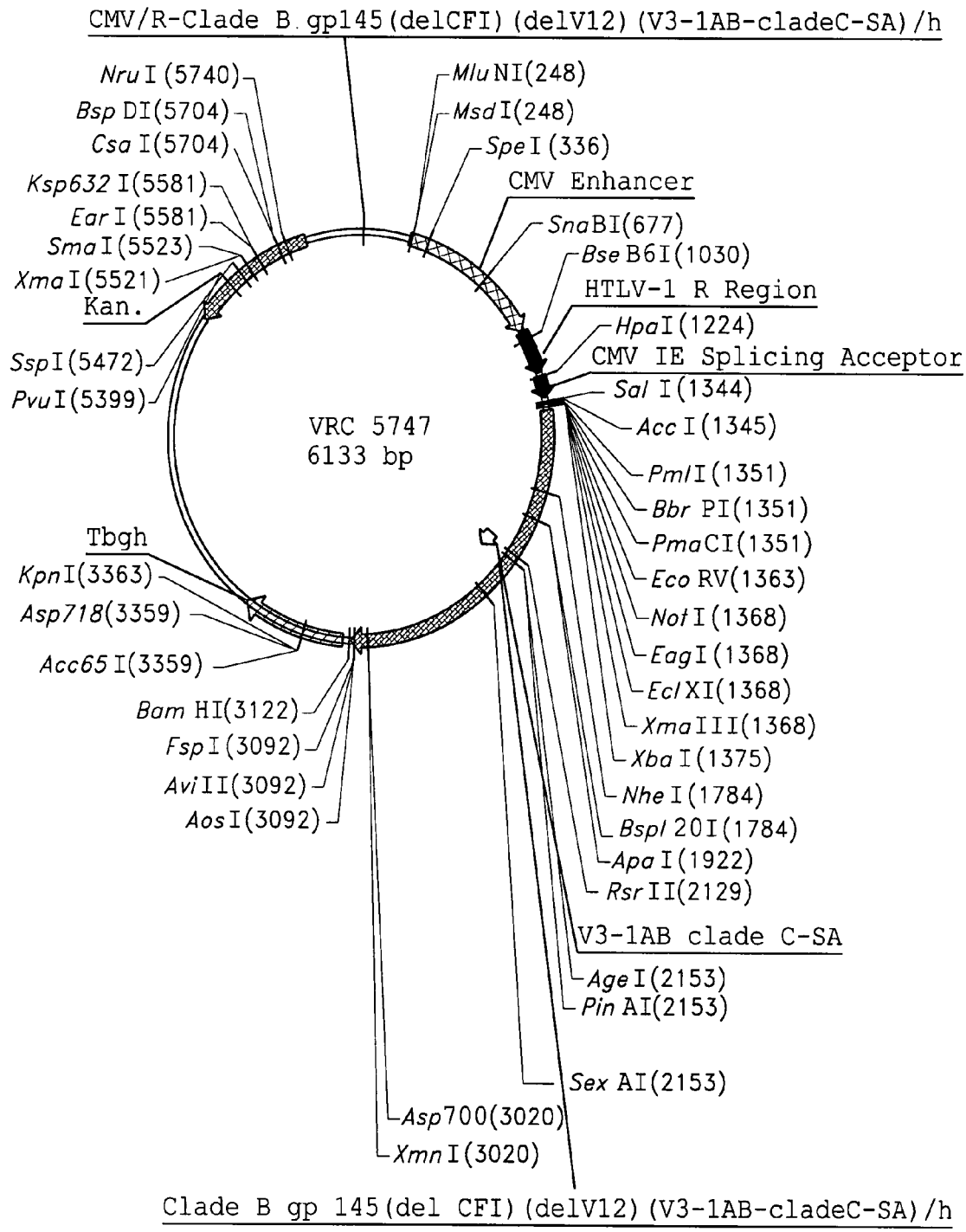

FIG. 46. Plasmid map for VRC 5747.

Figure 47:
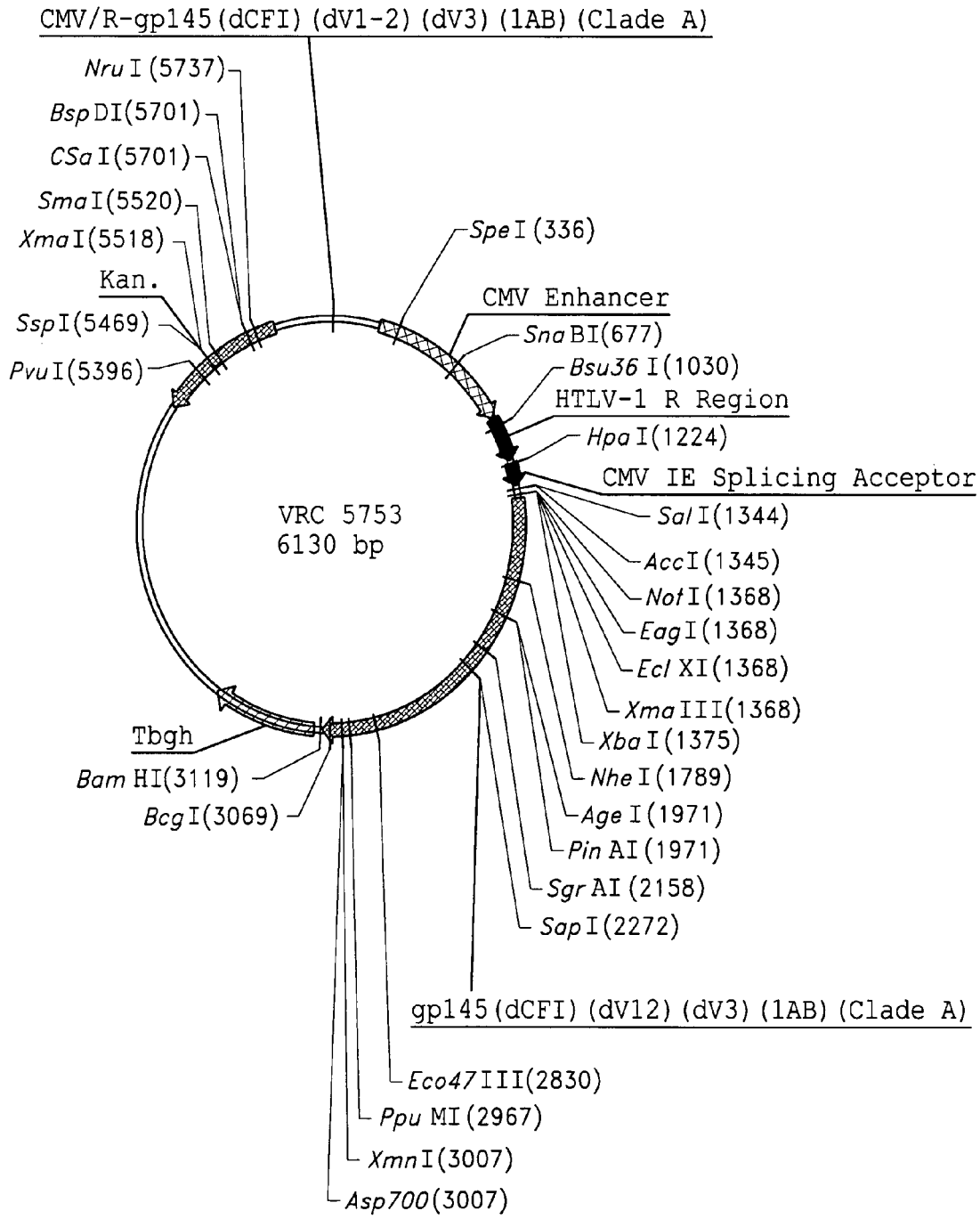

FIG. 47. Plasmid map for VRC5753.

Figure 48:
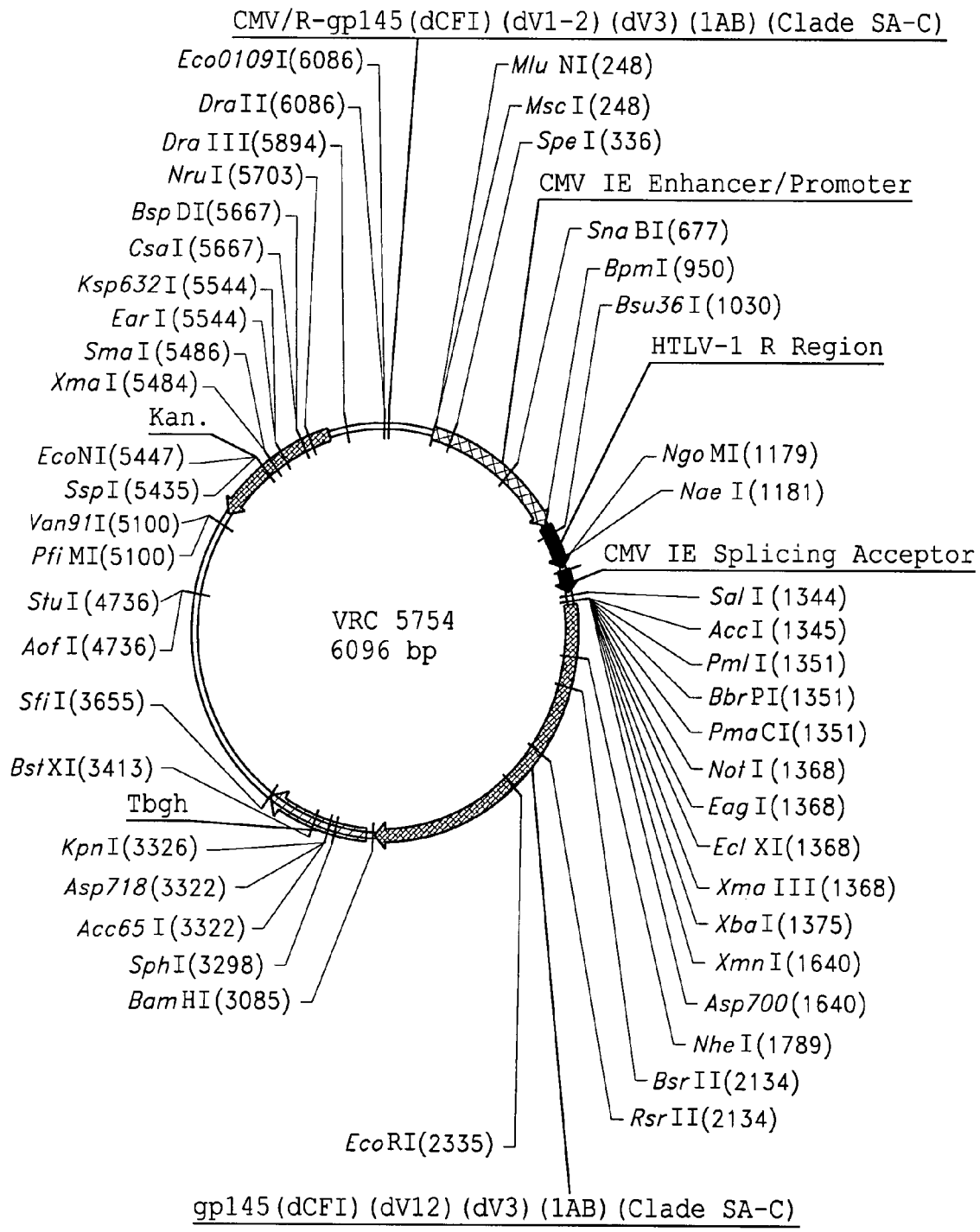

FIG. 48. Plasmid map for VRC 5754.

Figure 49:
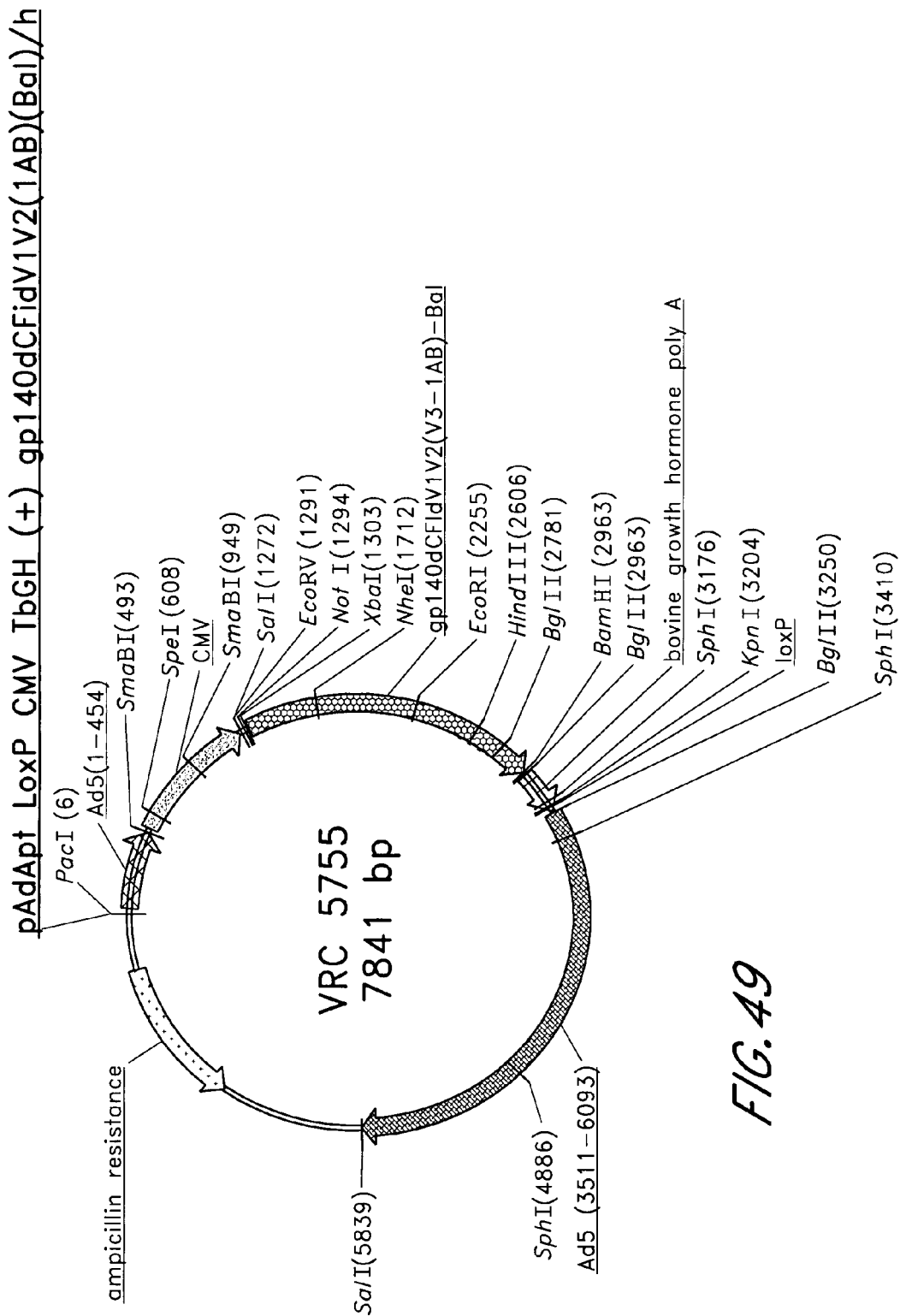

FIG. 49. Plasmid map for VRC 5755.

Figure 50:
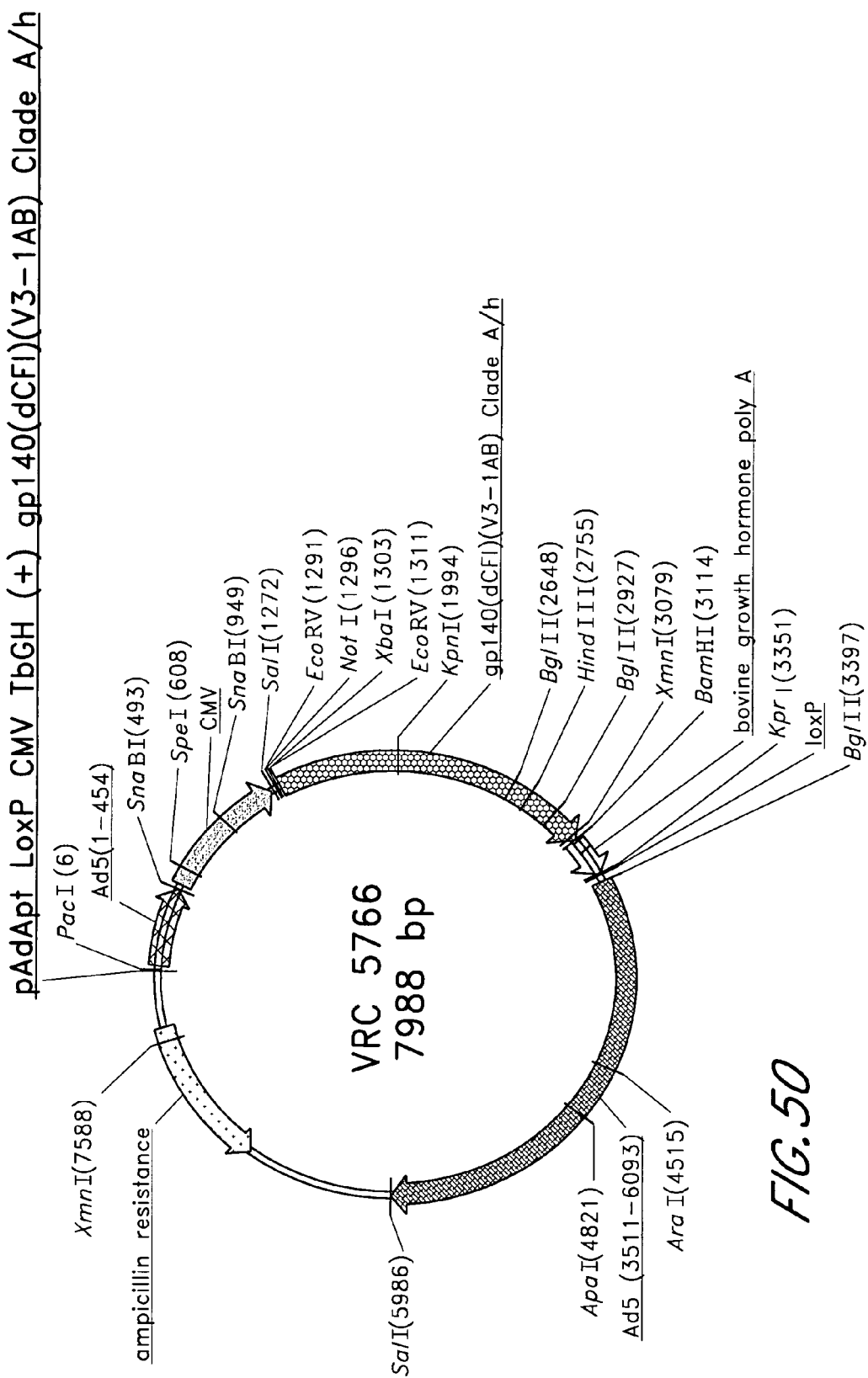

FIG. 50. Plasmid map for VRC 5766.

FIG. 51. Plasmid map for VRC 5767.

Figure 52:
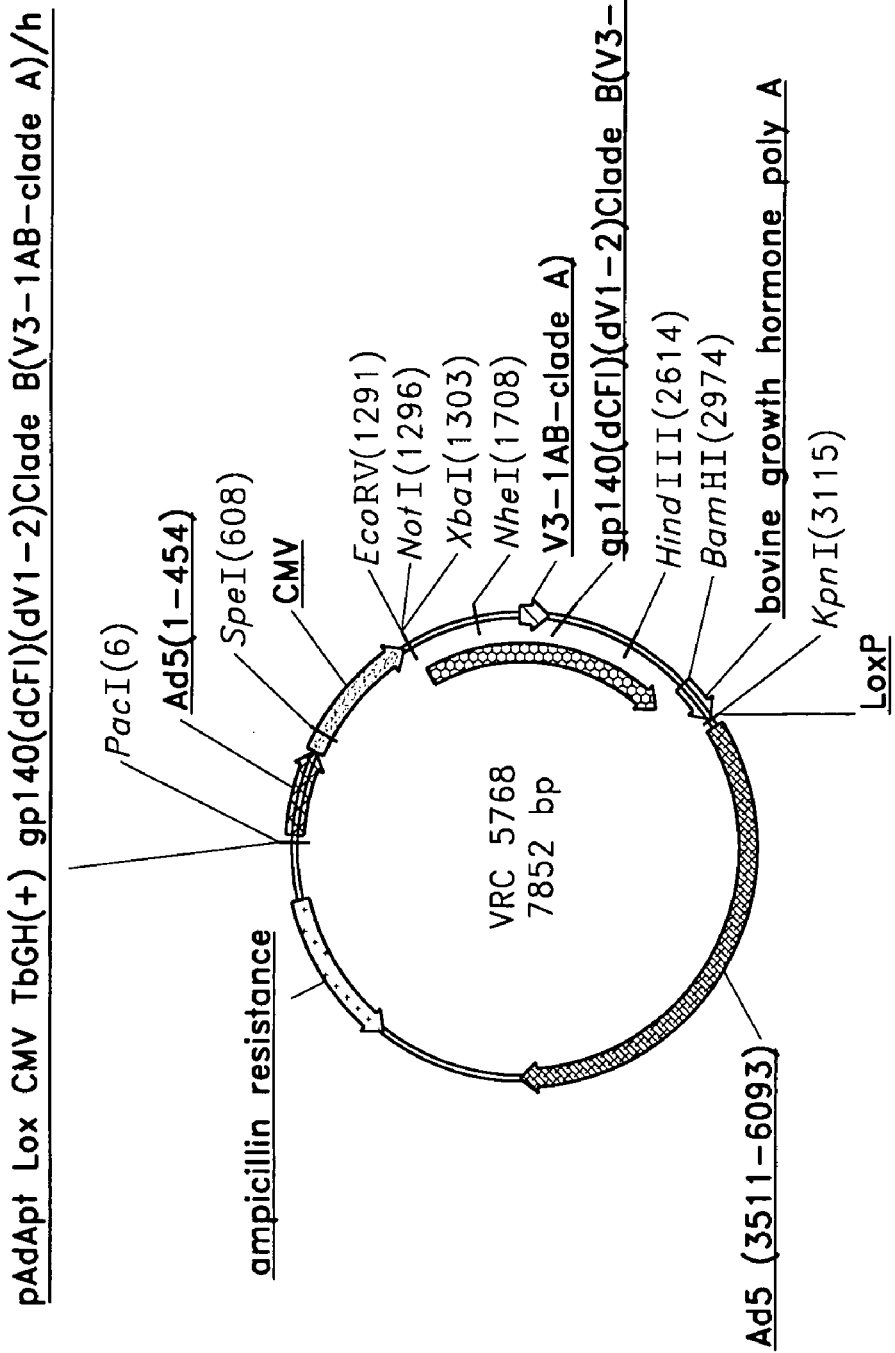

FIG. 52. Plasmid map for VRC 5768.

Figure 53:
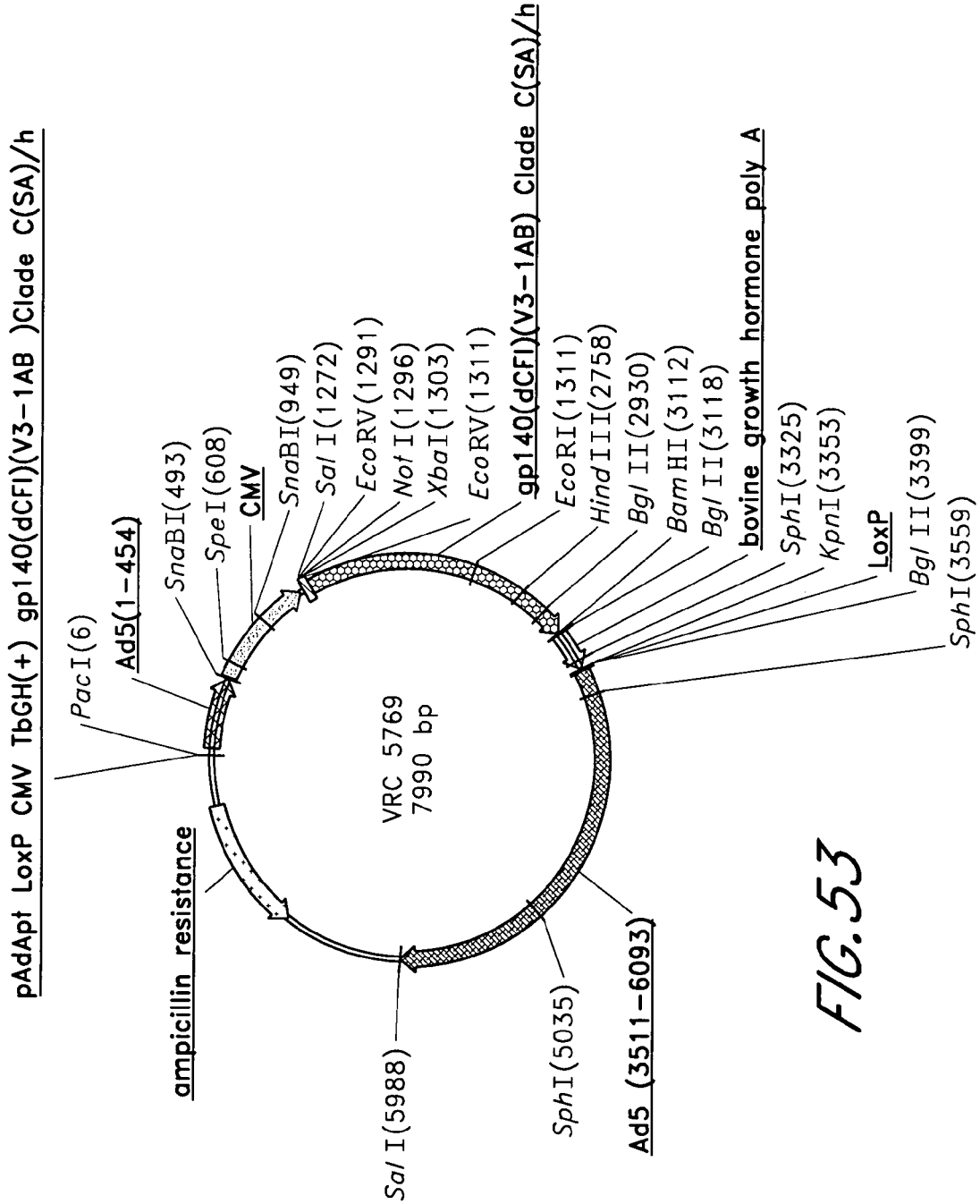

FIG. 53. Plasmid map for VRC 5769.

Figure 54:
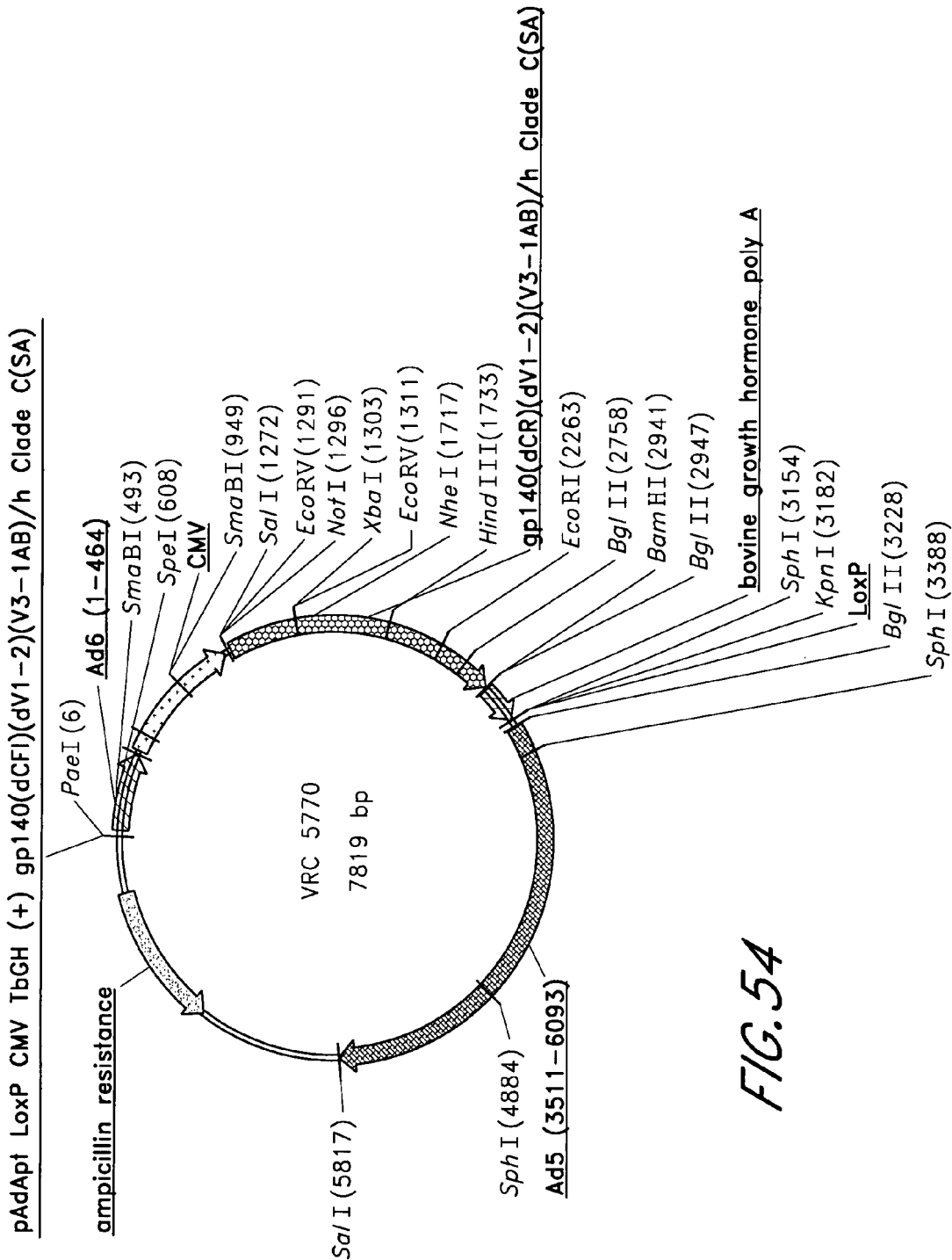

FIG. 54. Plasmid map for VRC 5770.

Figure 55:
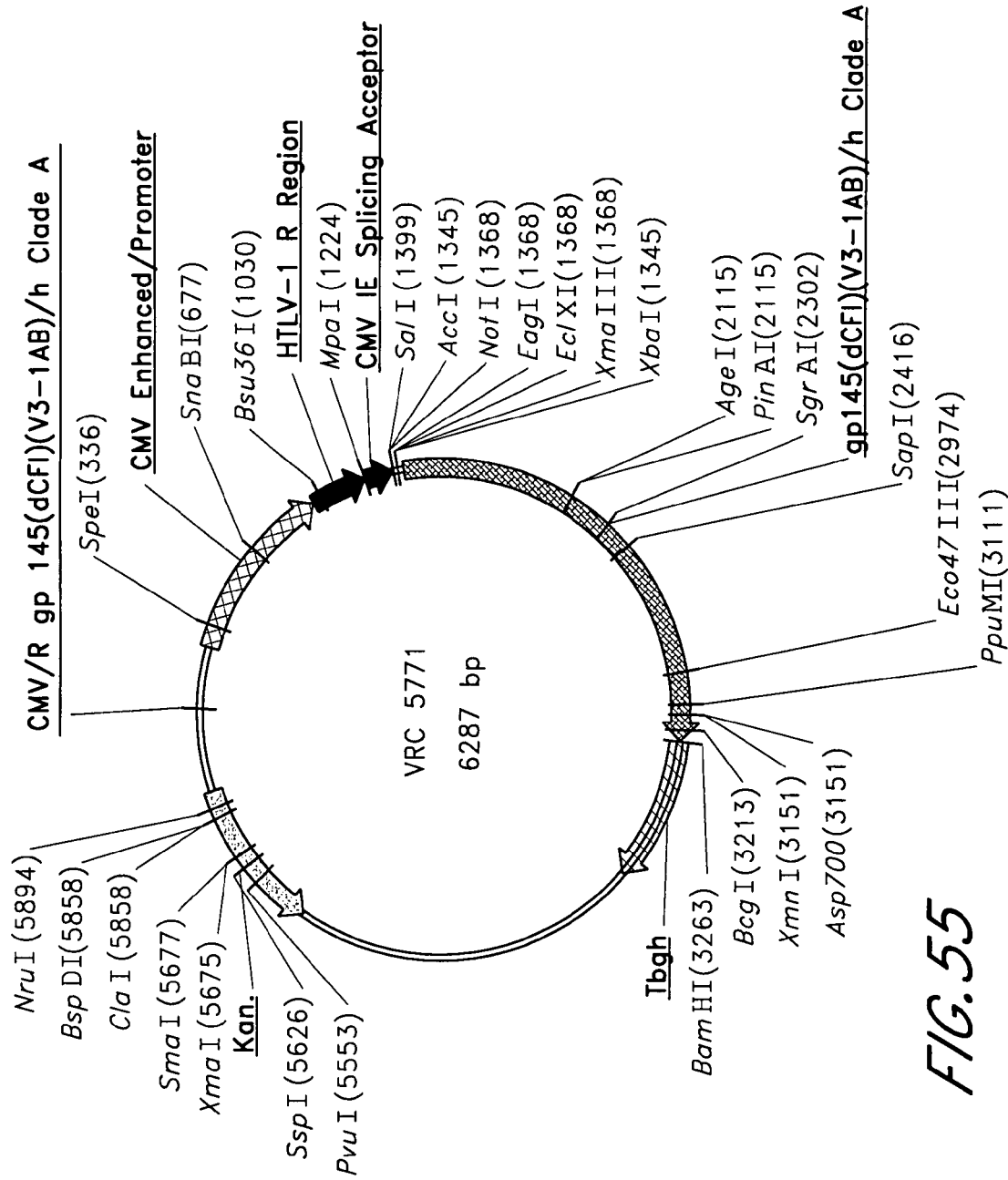

FIG. 55. Plasmid map for VRC 5771.

FIG. 56. Plasmid map for VRC 5772.

FIG. 57. Plasmid map for VRC 5773.

Figure 58:
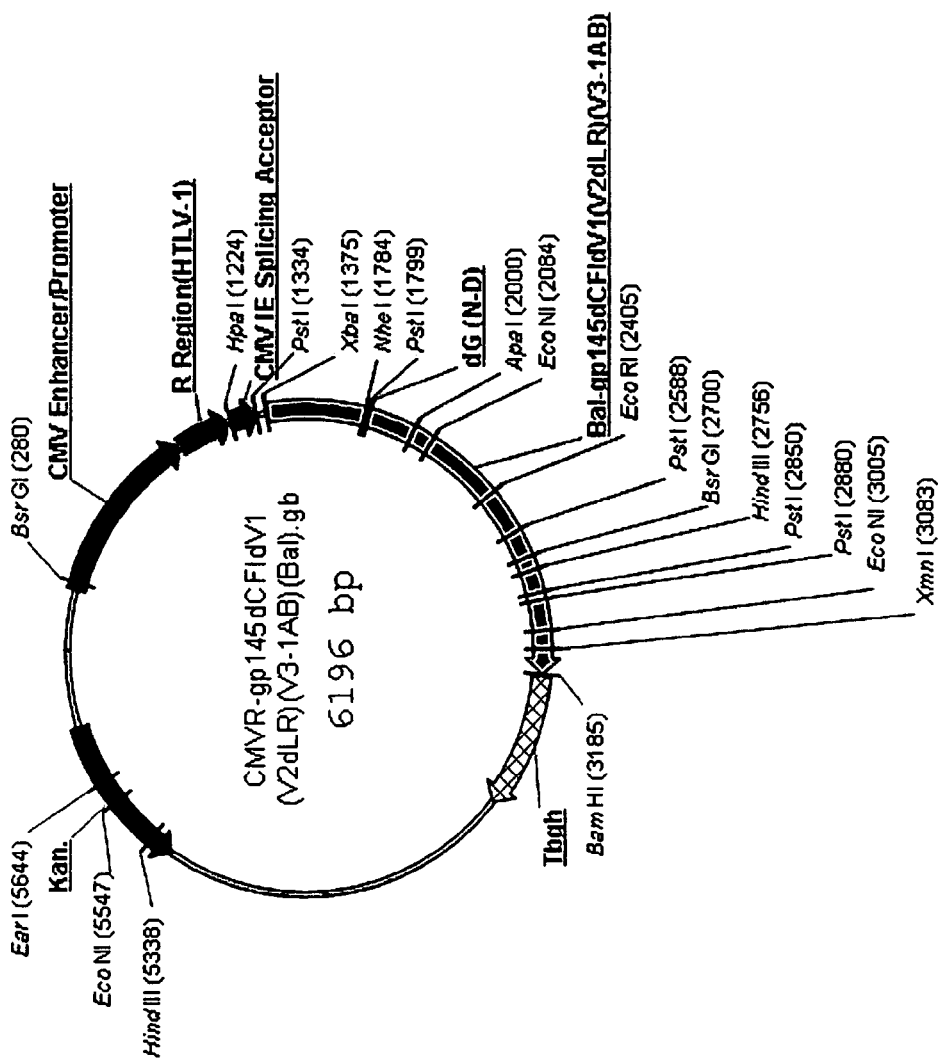

FIG. 58. Plasmid map for CMVR-gp145ΔCFIΔV1 (V2ΔLR)(V3-1AB)(Bal).

Figure 59:
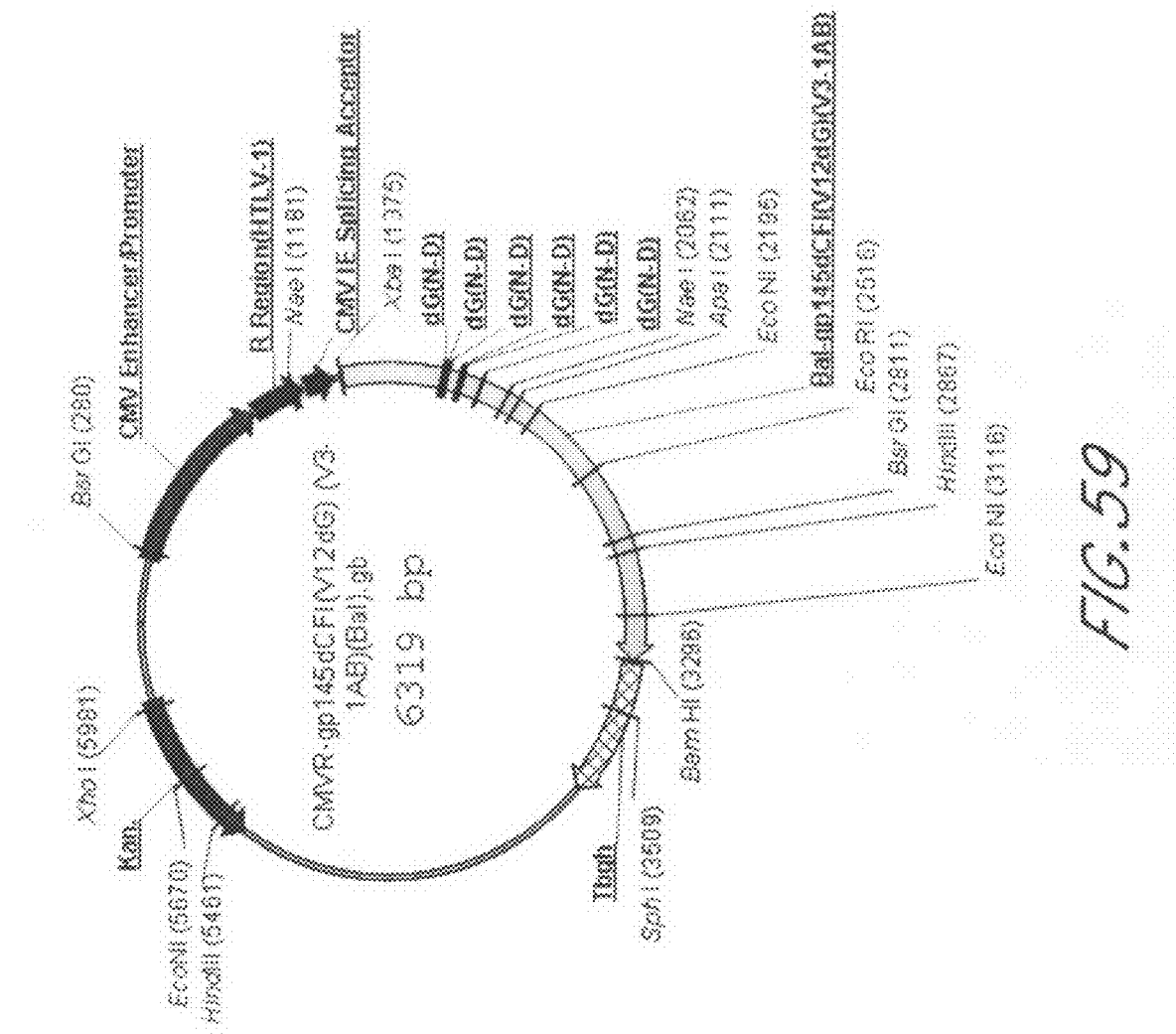

FIG. 59. Plasmid map for CMVR-gp145ΔCFI(V1V2ΔG) (V3-1AB)(Bal).

Figure 60:
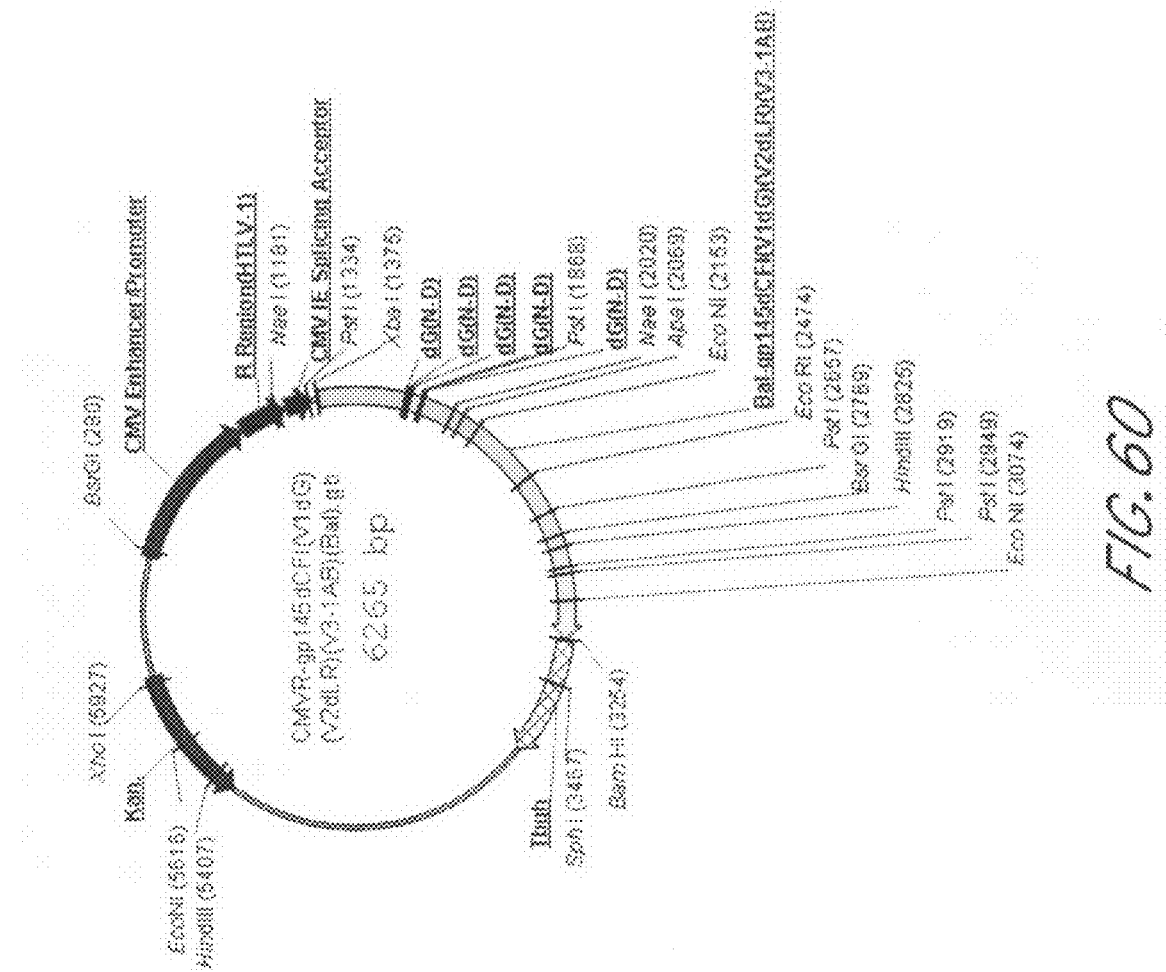

FIG. 60. Plasmid map for CMVR-gp145ΔCFI(V1ΔG) (V2ΔLR)(V3-1AB)(Bal).

Figure 61:
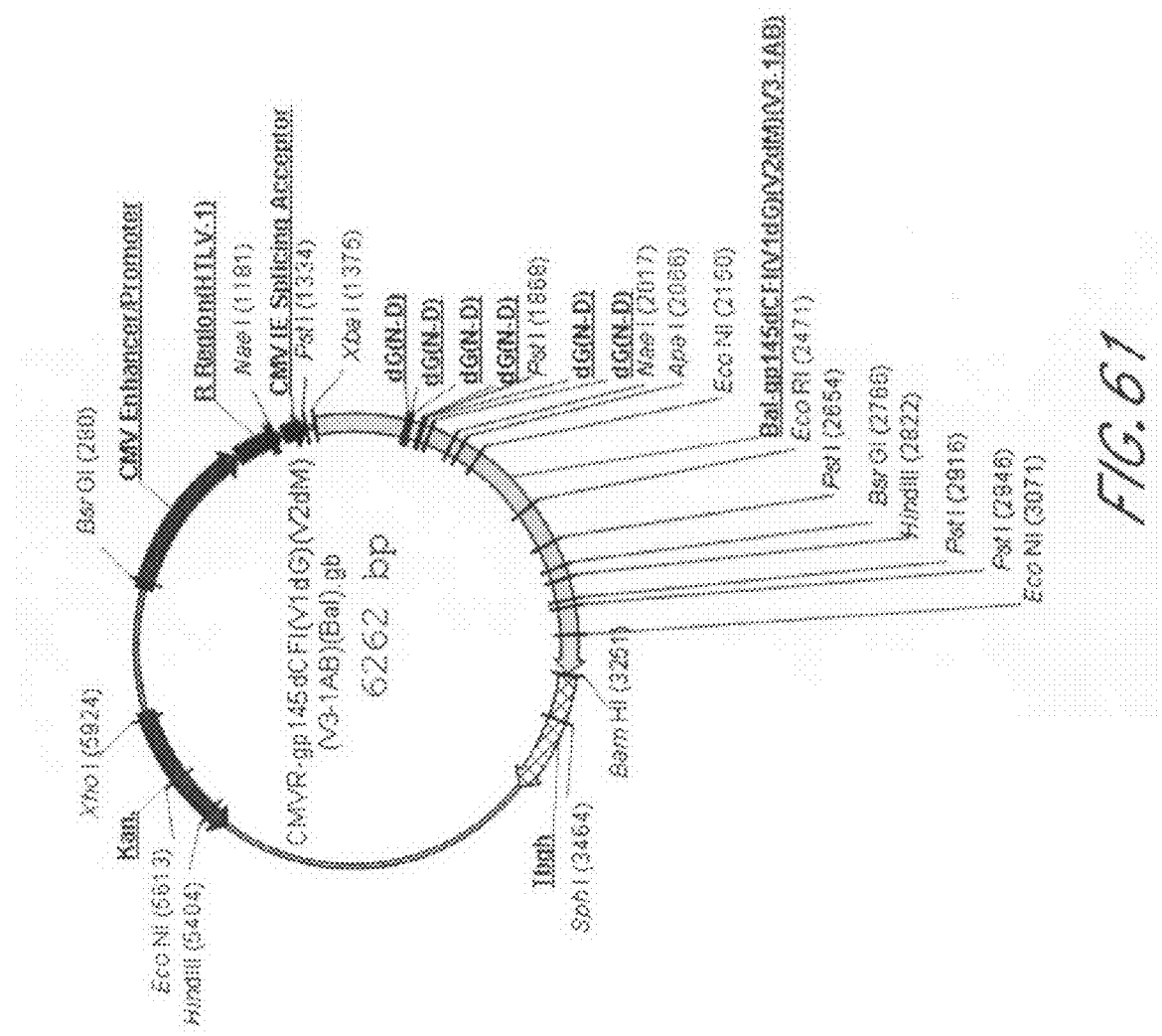

FIG. 61. Plasmid map for CMVR-gp145ΔCFI(V1ΔG) (V2ΔM)(V3-1AB)(Bal).

Figure 62:
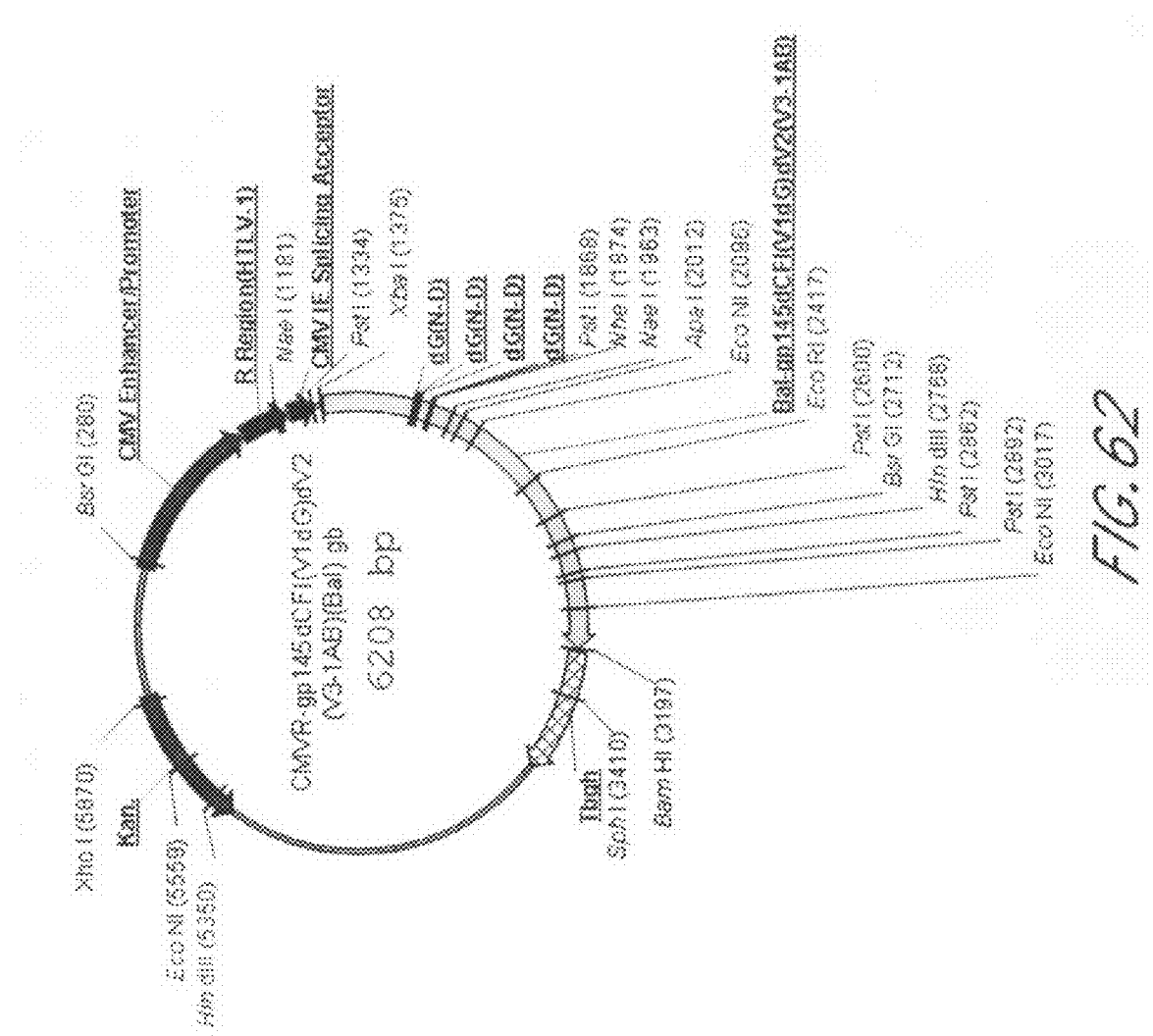

FIG. 62. Plasmid map for CMVR-gp145ΔCFI(V1ΔG)ΔV2 (V3-1AB)(Bal).

Figure 63:
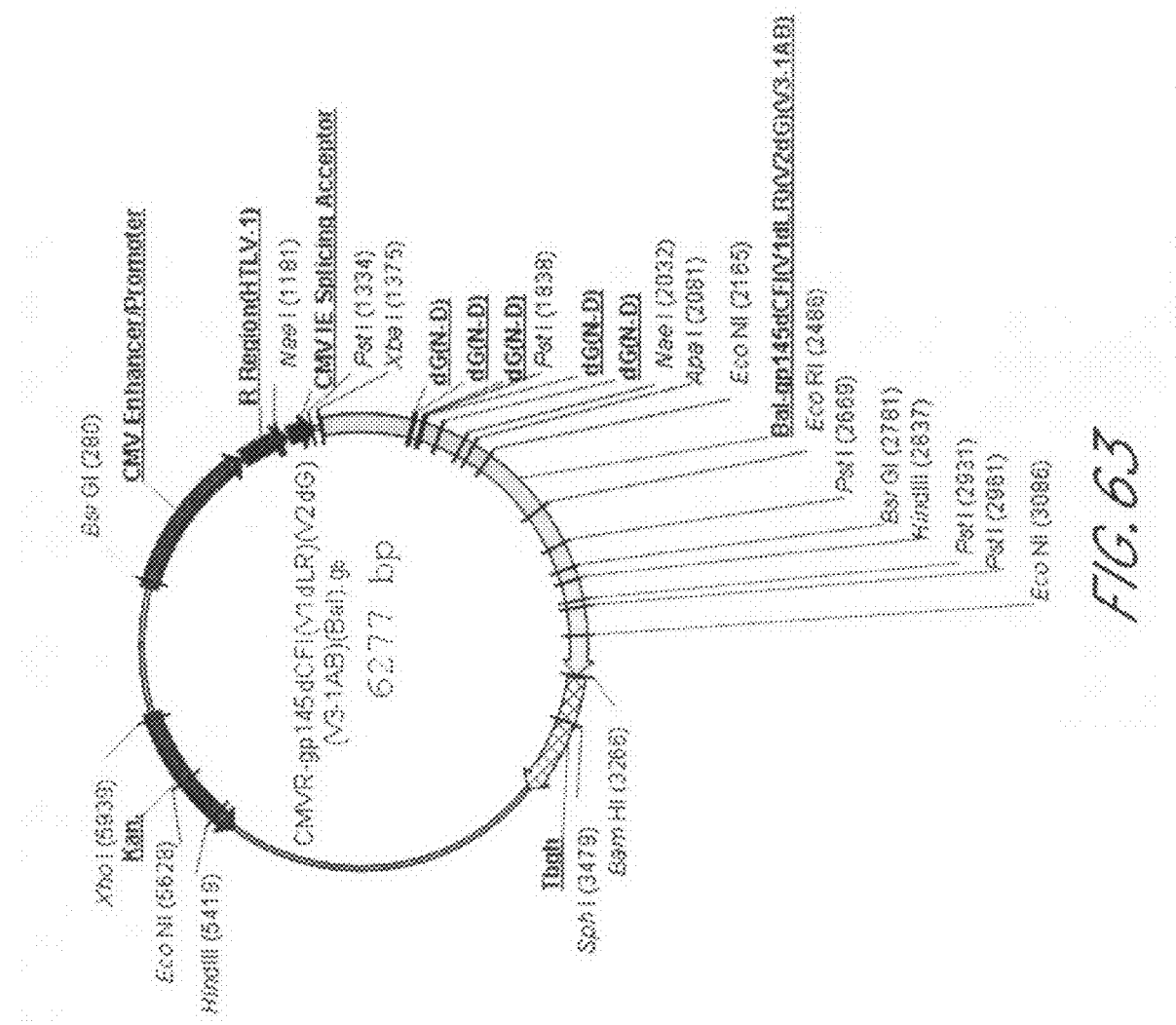

FIG. 63. Plasmid map for CMVR-gp145ΔCFI(V1ΔLR) (V2ΔG)(V3-1AB)(Bal).

Figure 64:
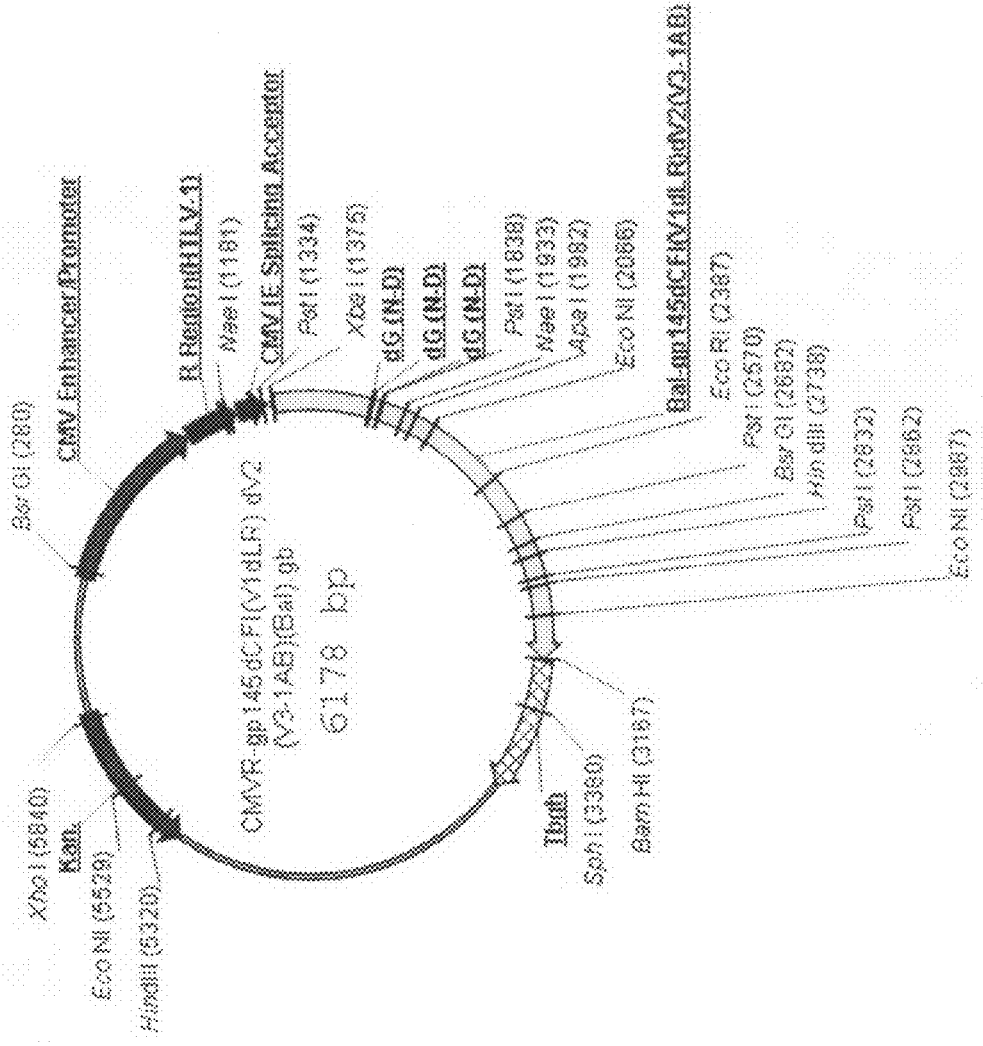

FIG. 64. Plasmid map for CMVR-gp145ΔCFI(V1ΔLR) ΔV2(V3-1AB)(Bal).

Figure 65:
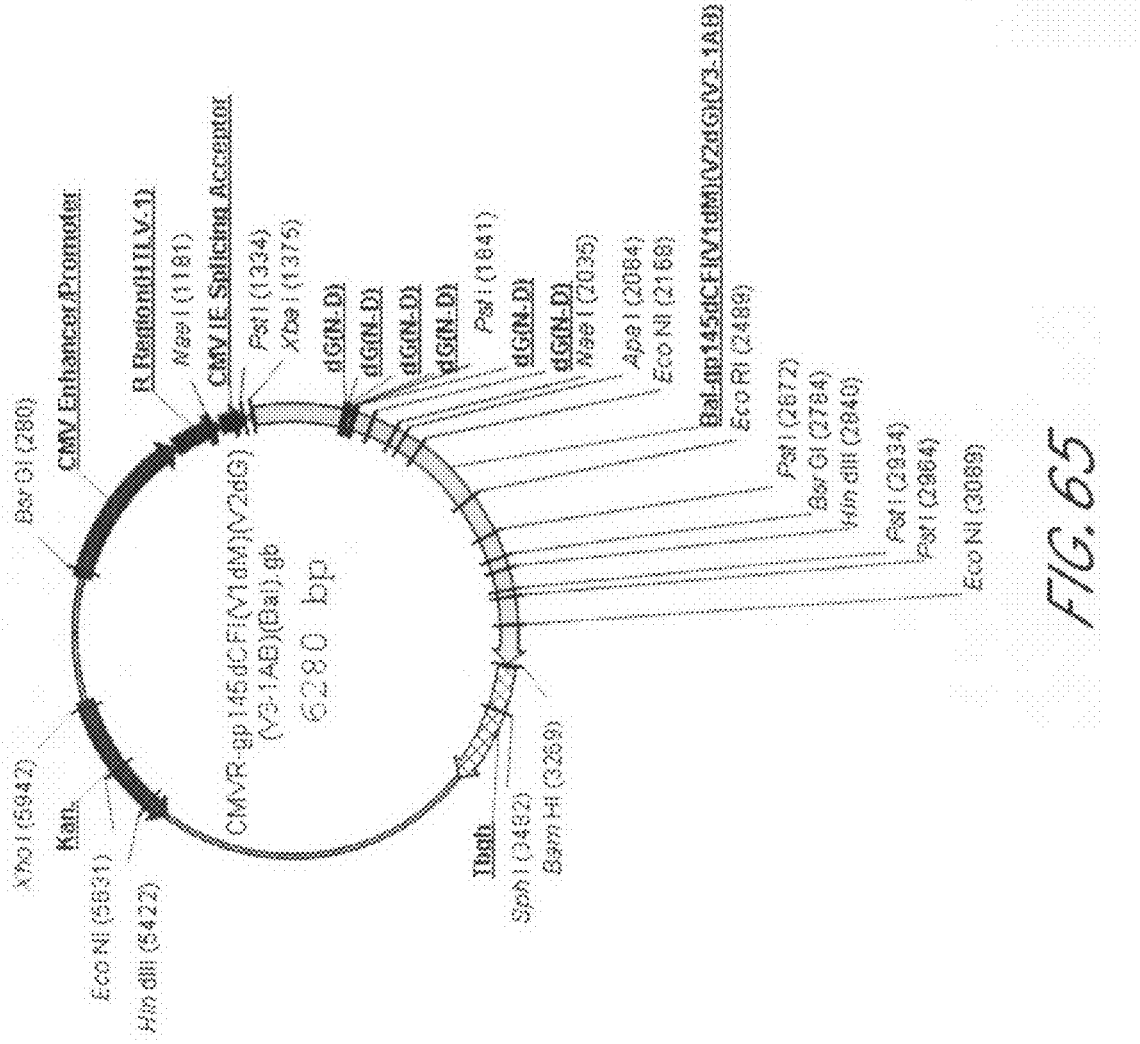

FIG. 65. Plasmid map for CMVR-gp145ΔCFI(V1ΔM) (V2ΔG)(V3-1AB)(Bal).

Figure 66:
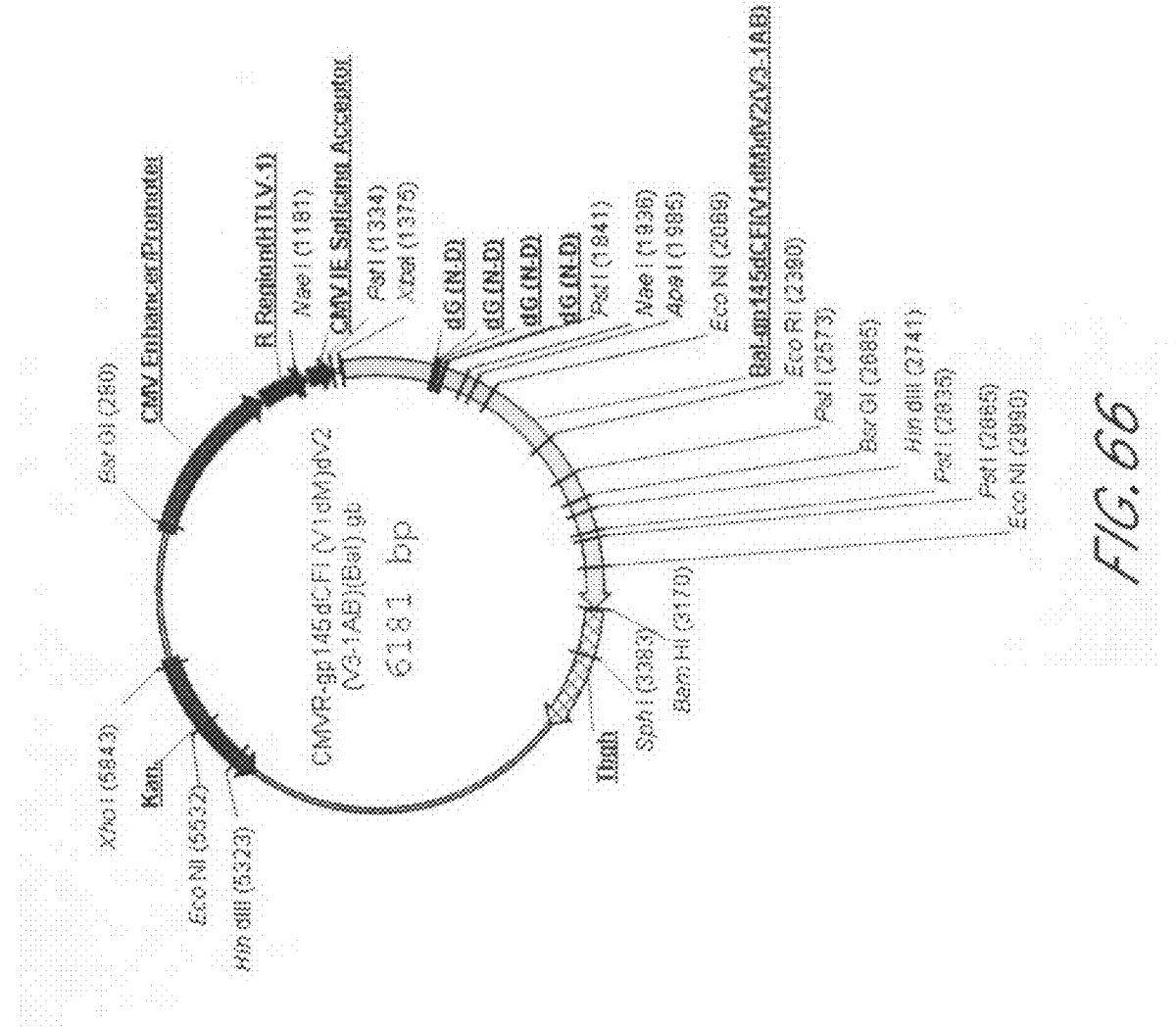

FIG. 66. Plasmid map for CMVR-gp145ΔCFI(V1ΔM) ΔV2(V3-1AB)(Bal).

Figure 67:
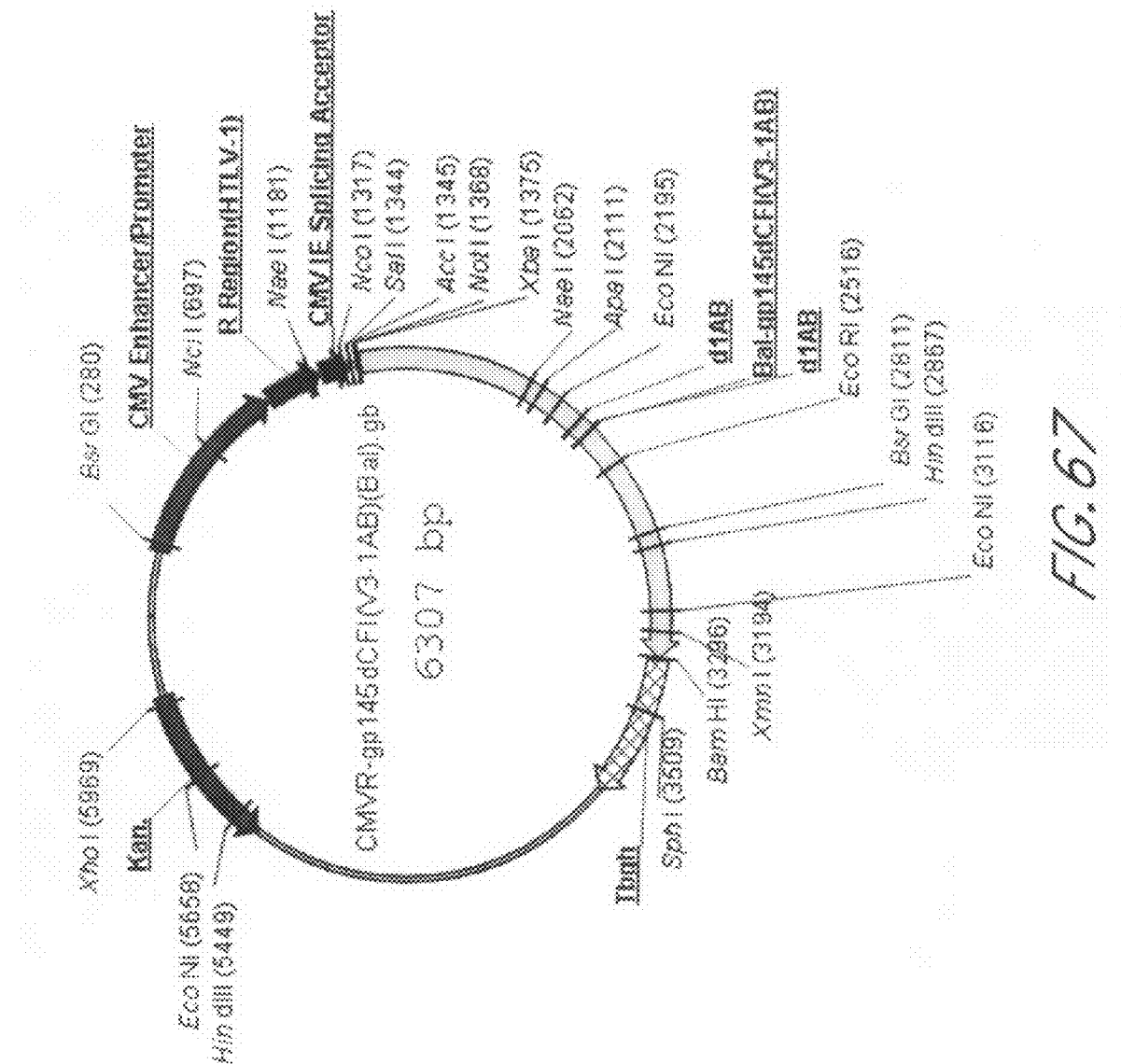

FIG. 67. Plasmid map for CMVR-gp145ΔCFI(V3-1AB) (Bal).

Figure 68:
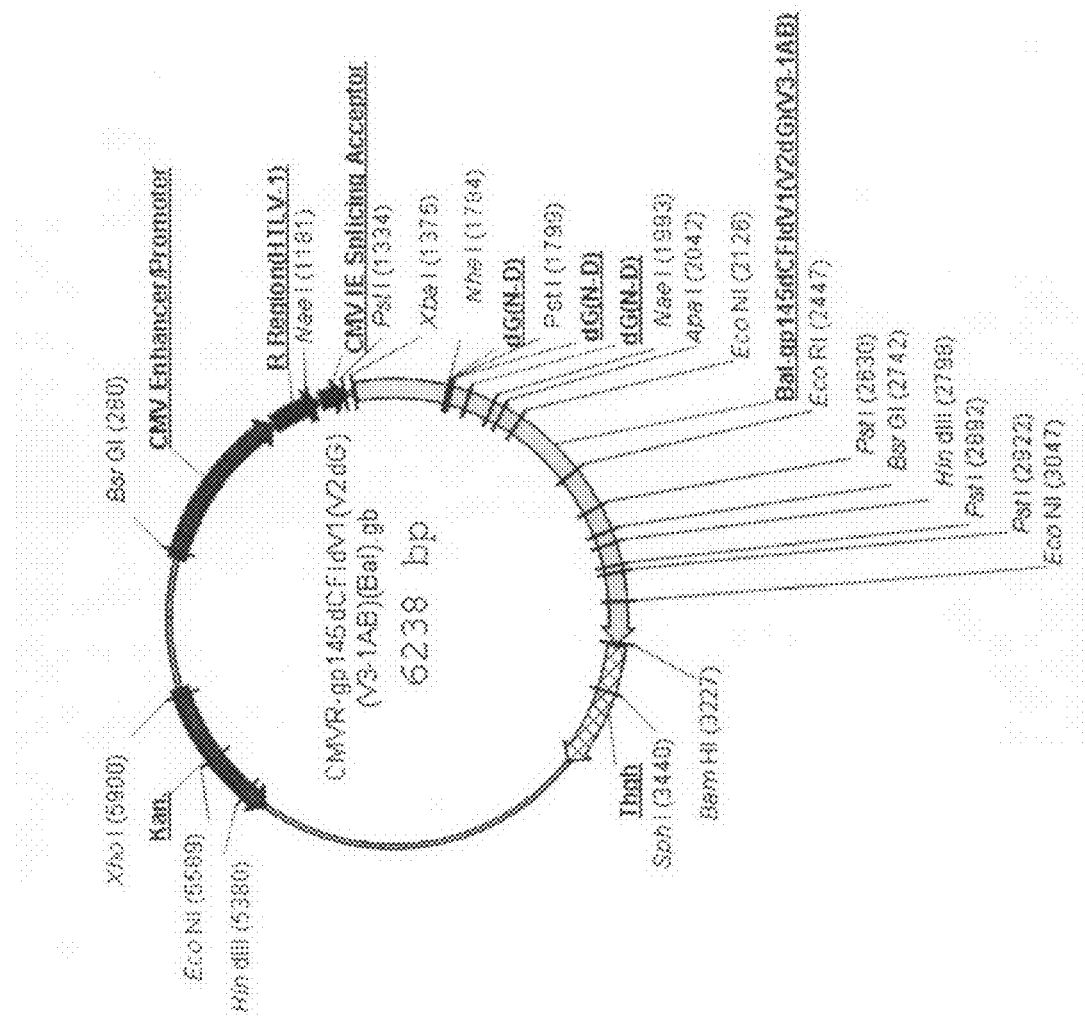

FIG. 68. Plasmid map for CMVR-gp145ΔCFIΔV1(V2ΔG) (V3-1AB)(Bal).

Figure 69:
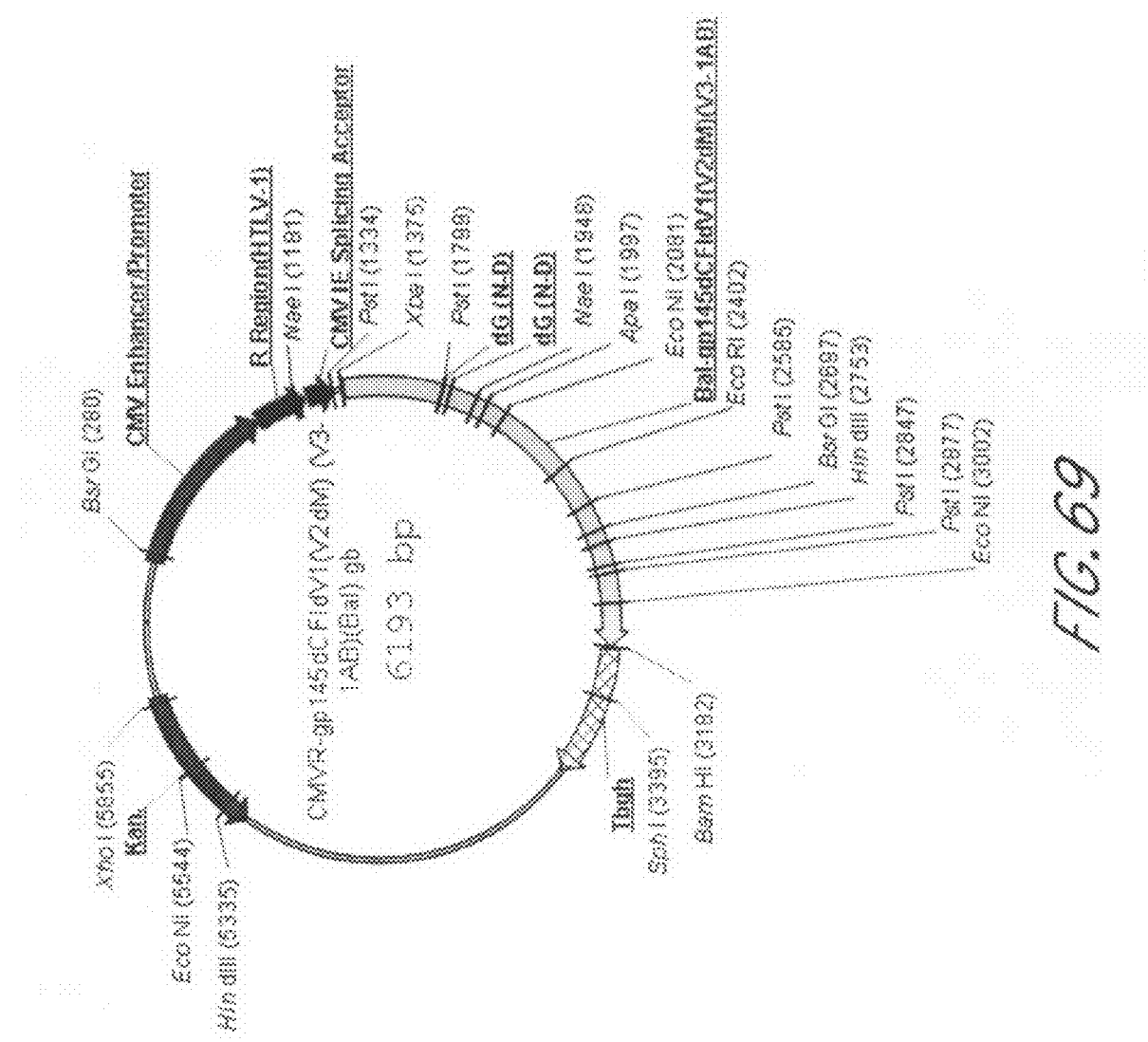

FIG. 69. Plasmid map for CMVR-gp145ΔCFIΔV1 (V2ΔM)(V3-1AB)(Bal).

Figure 70:
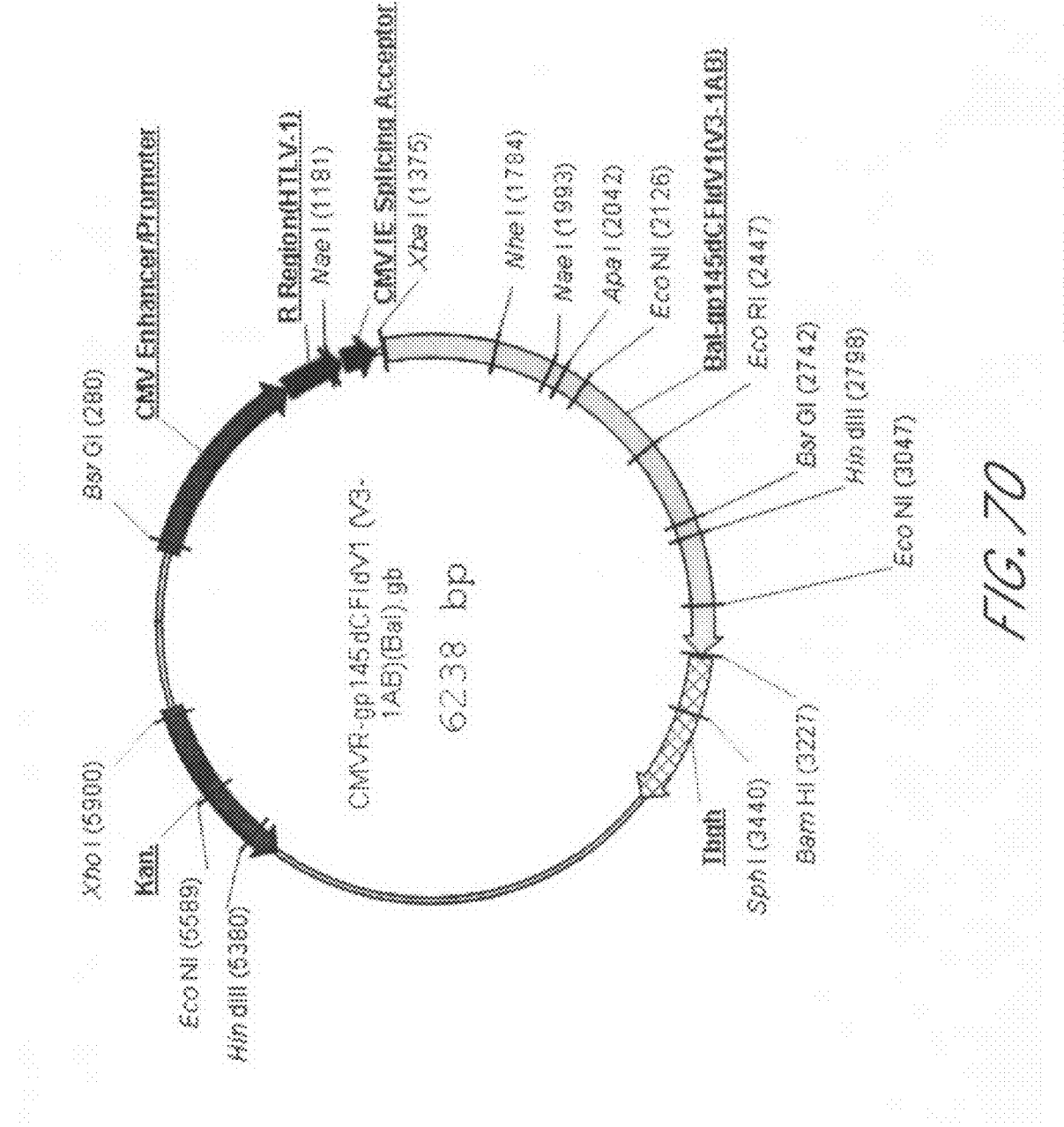

FIG. 70. Plasmid map for CMVR-gp145ΔCFIΔV1(V3-1AB)(Bal).

Figure 71:
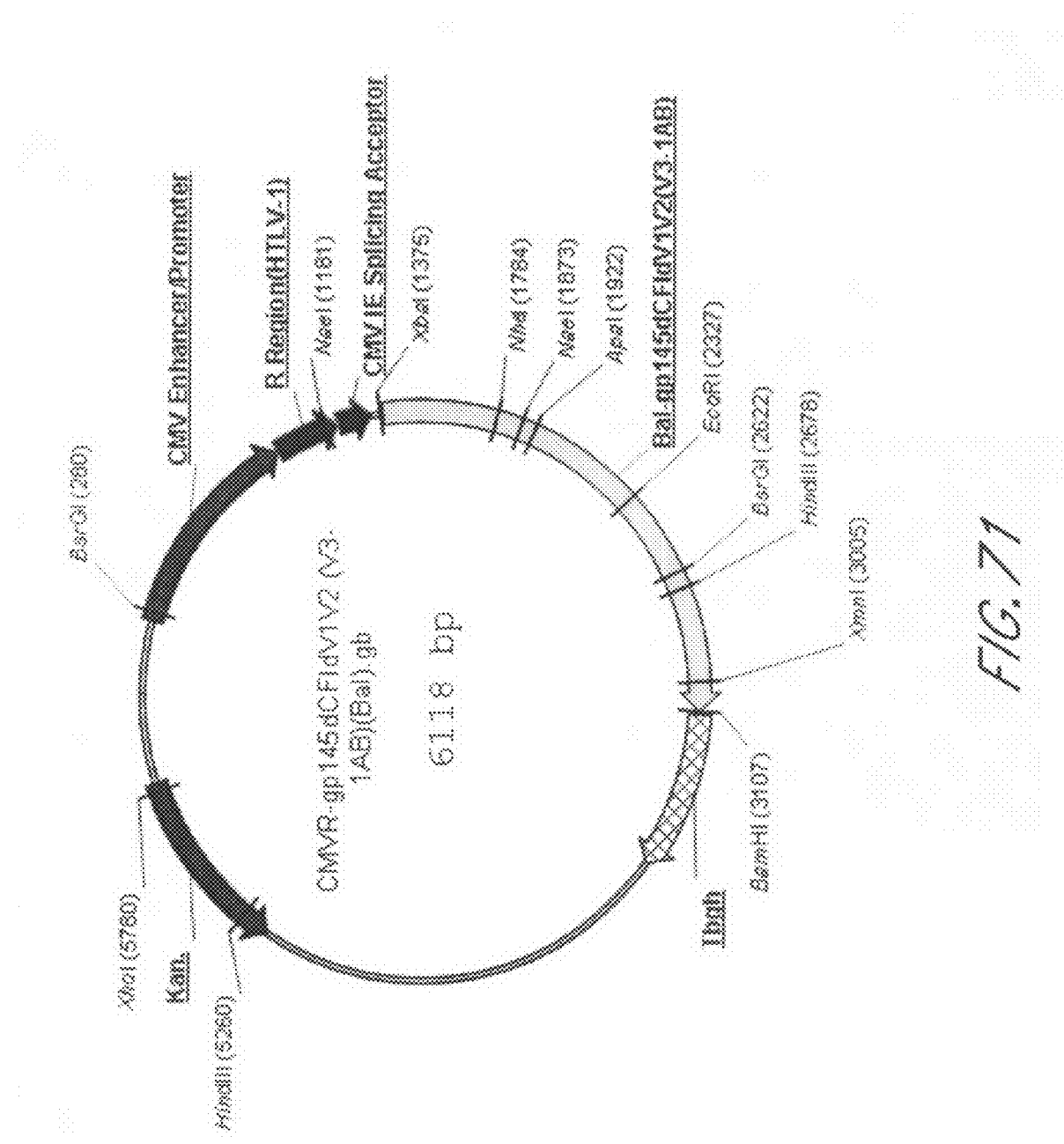

FIG. 71. Plasmid map for CMVR-gp145ΔCFIΔV1V2(V3-1AB)(Bal).

Figure 72:
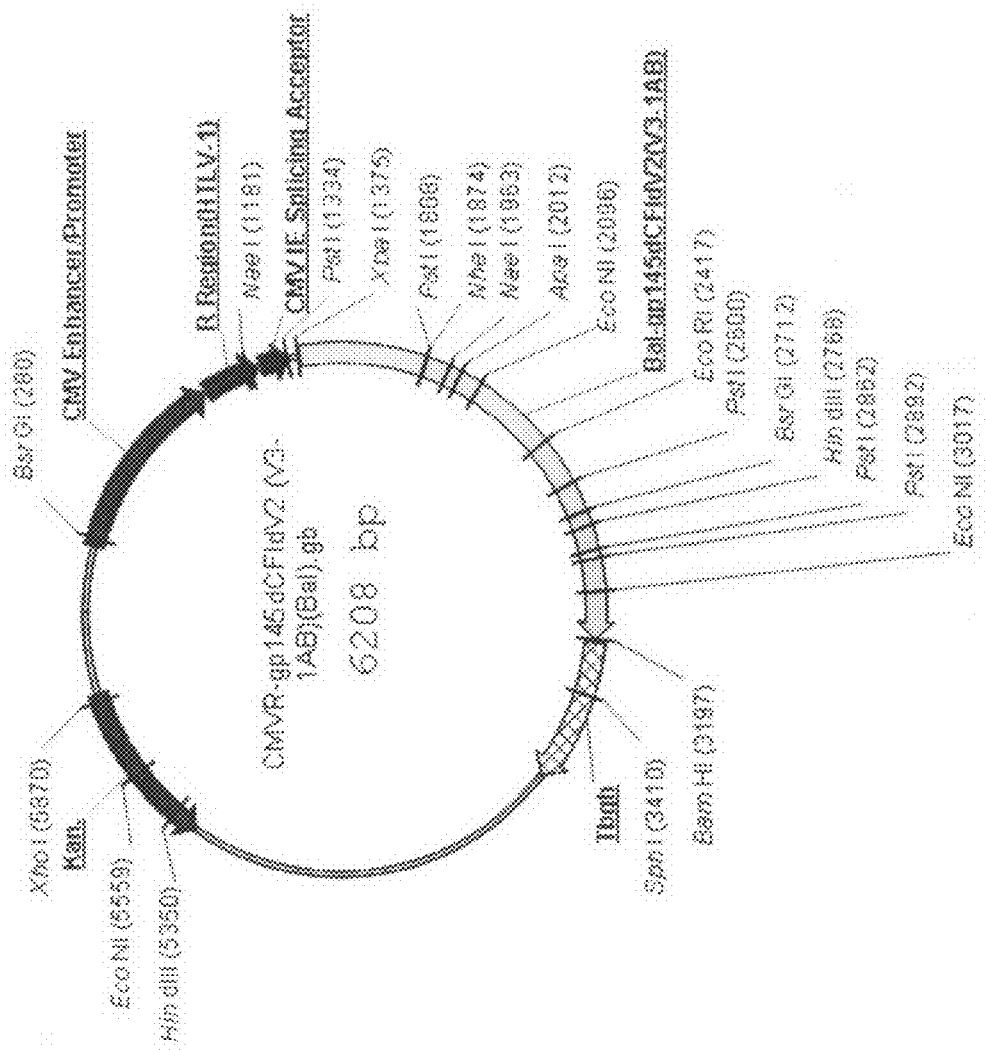

FIG. 72. Plasmid map for CMVR-gp145ΔCFIΔV2(V3-1AB)(Bal).

Figure 73:
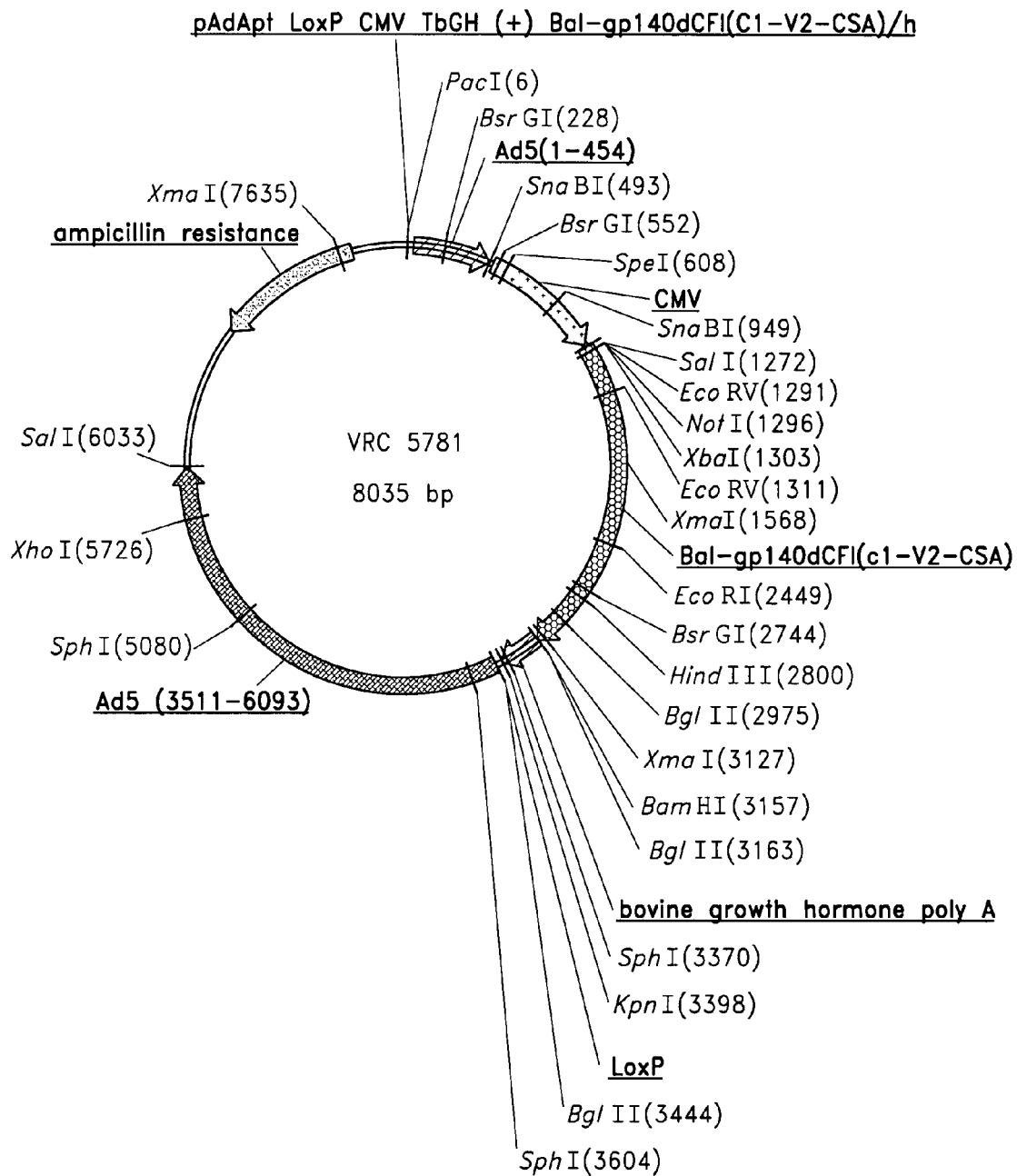
Figure 74:
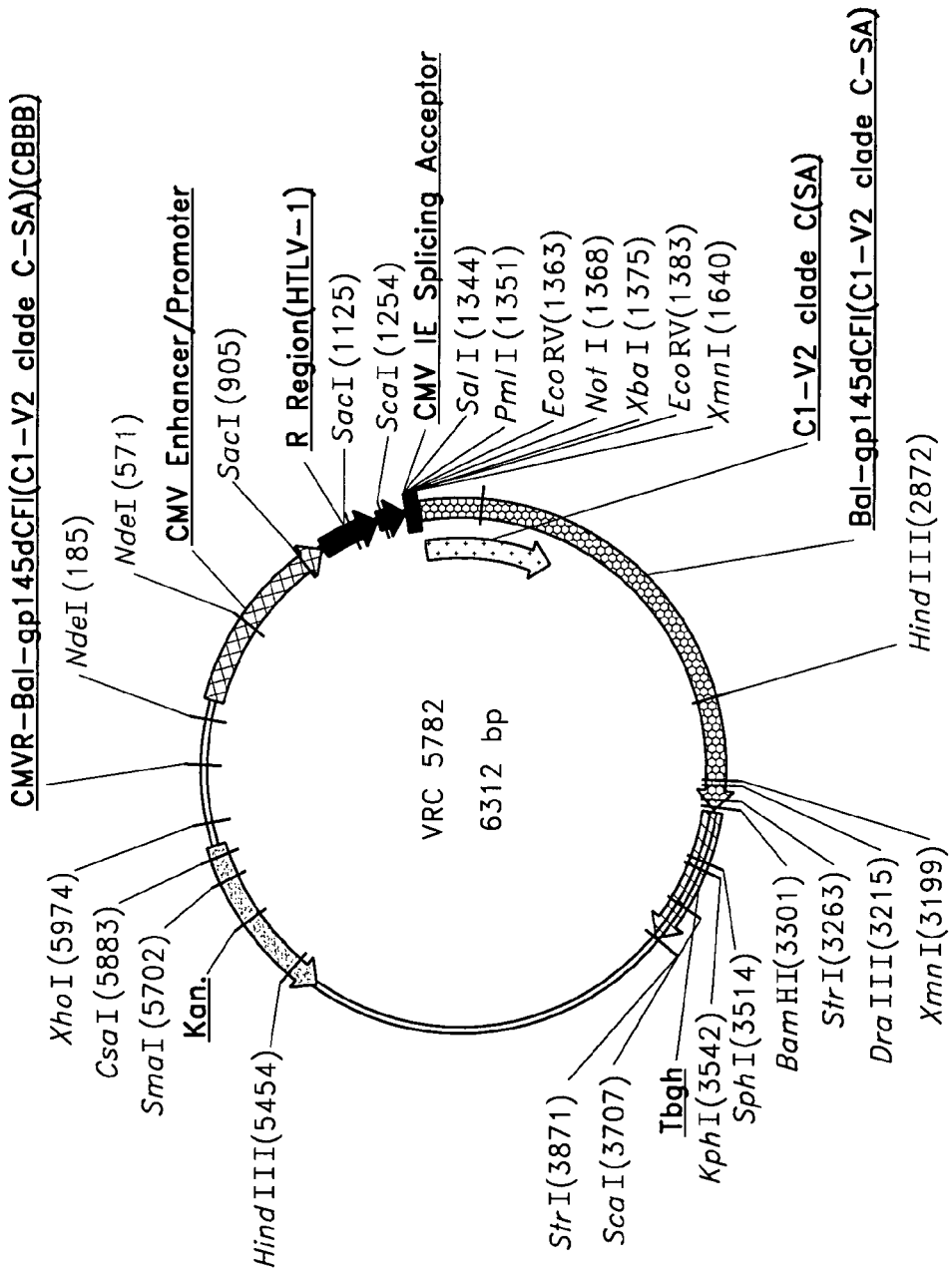
Figure 75:
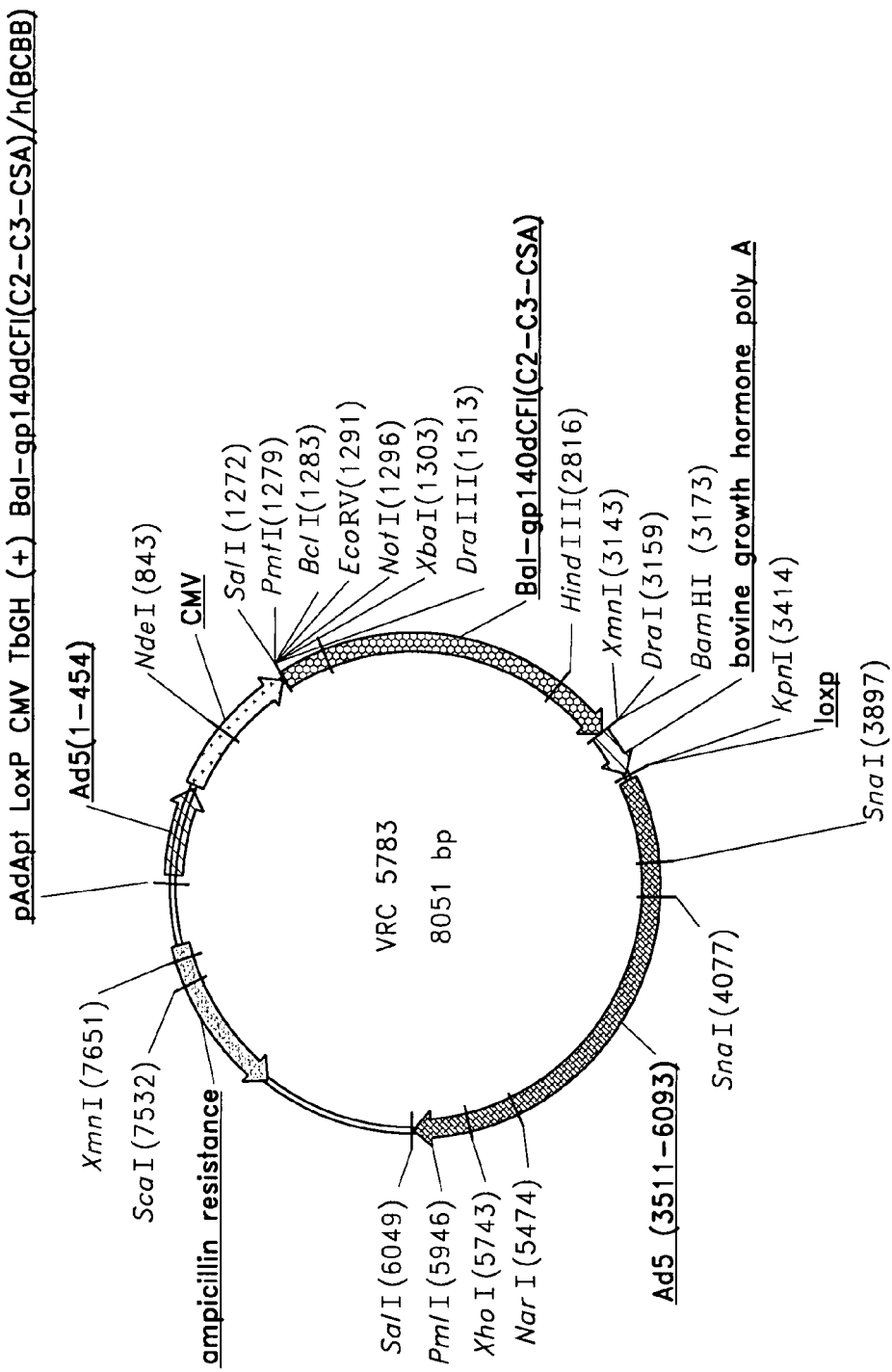
Figure 76:
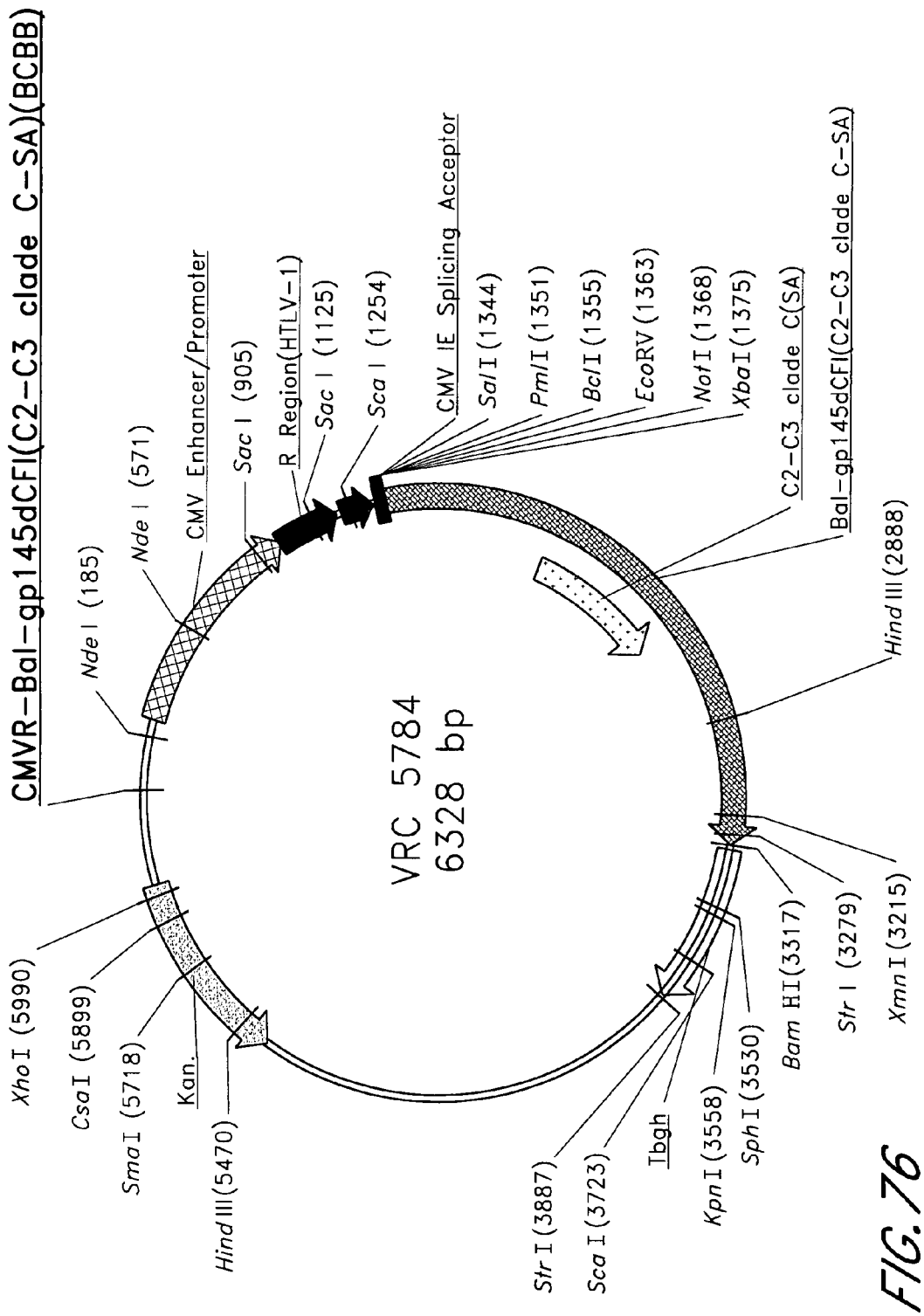
Figure 77:
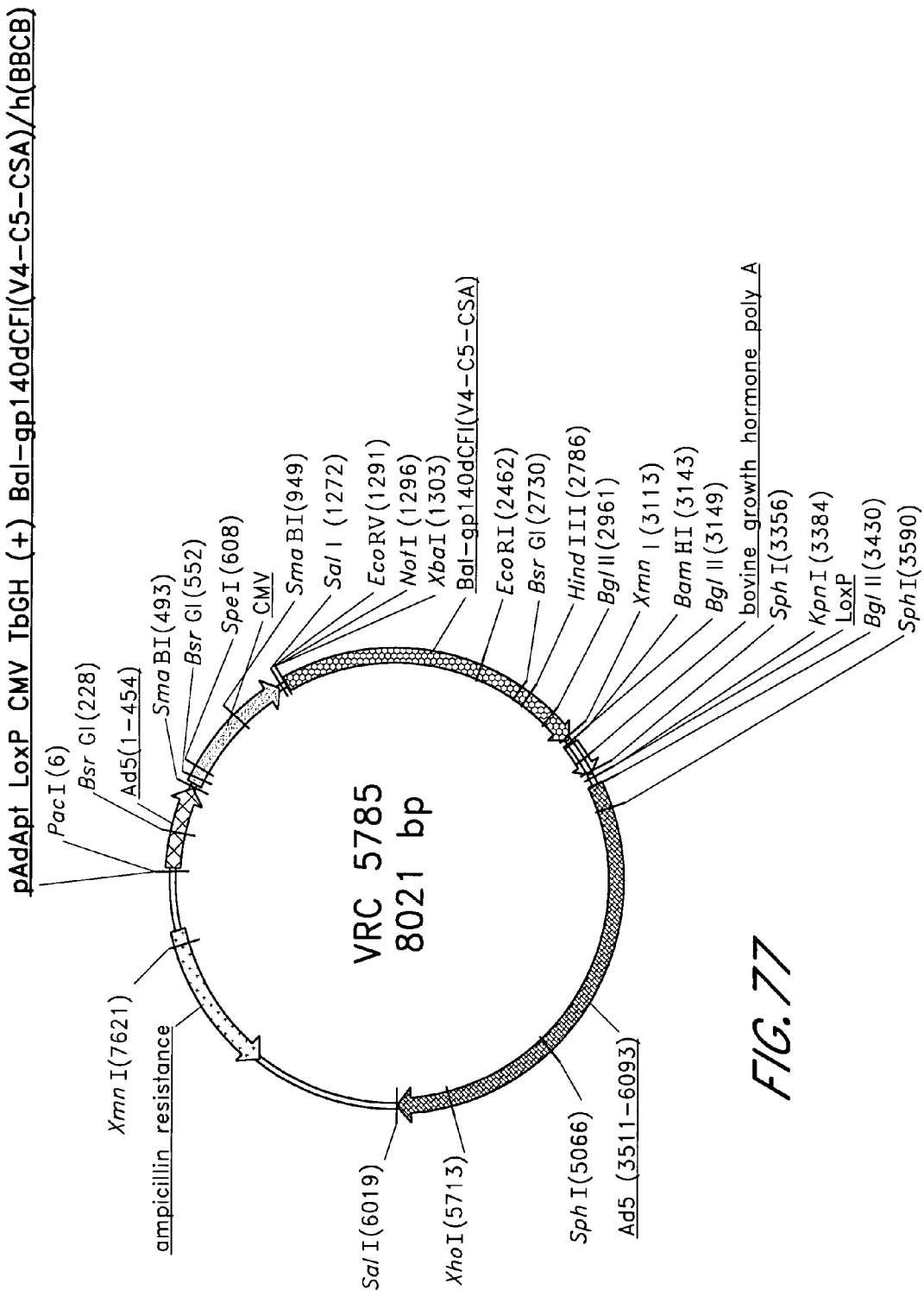
Figure 78:
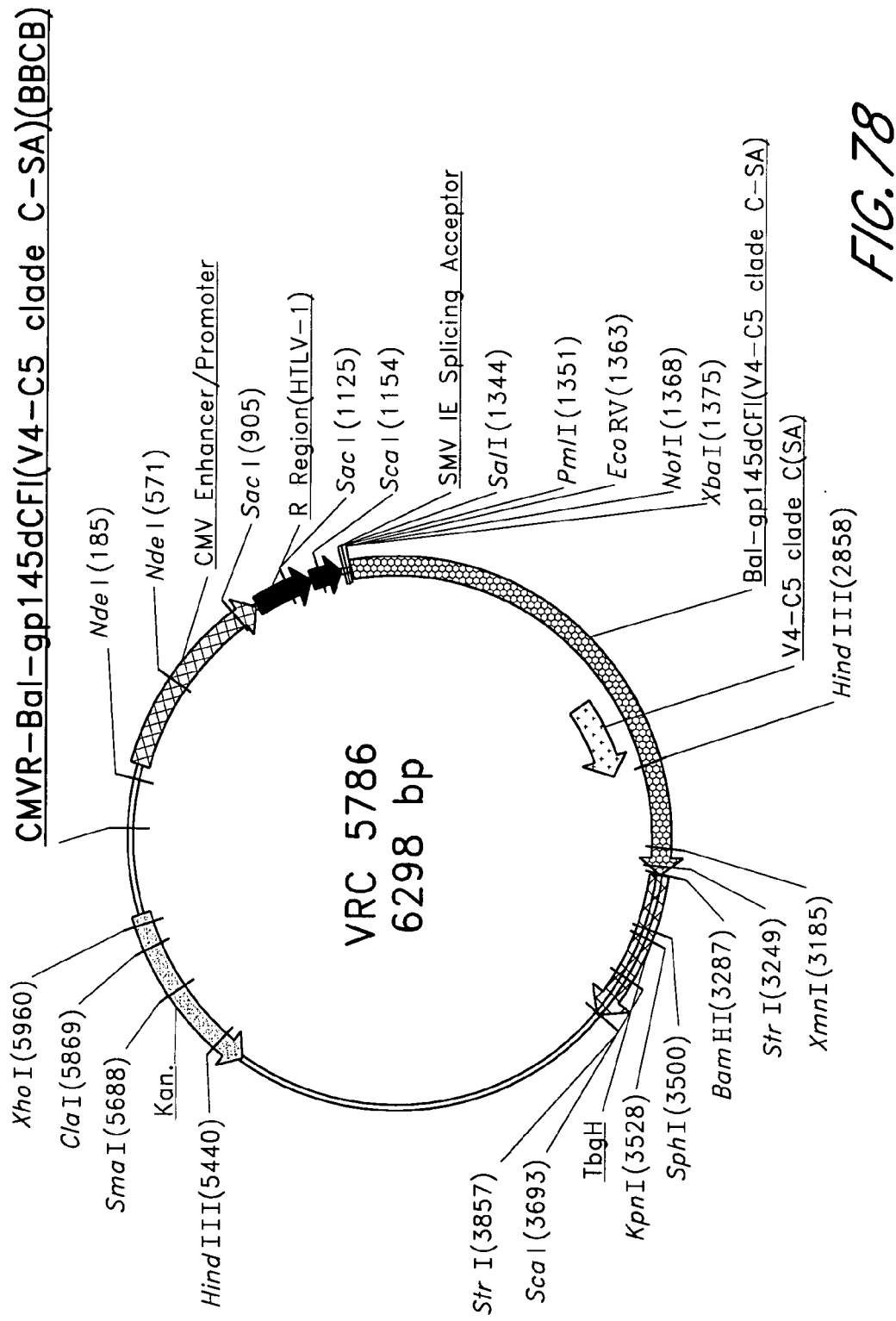
Figure 79:
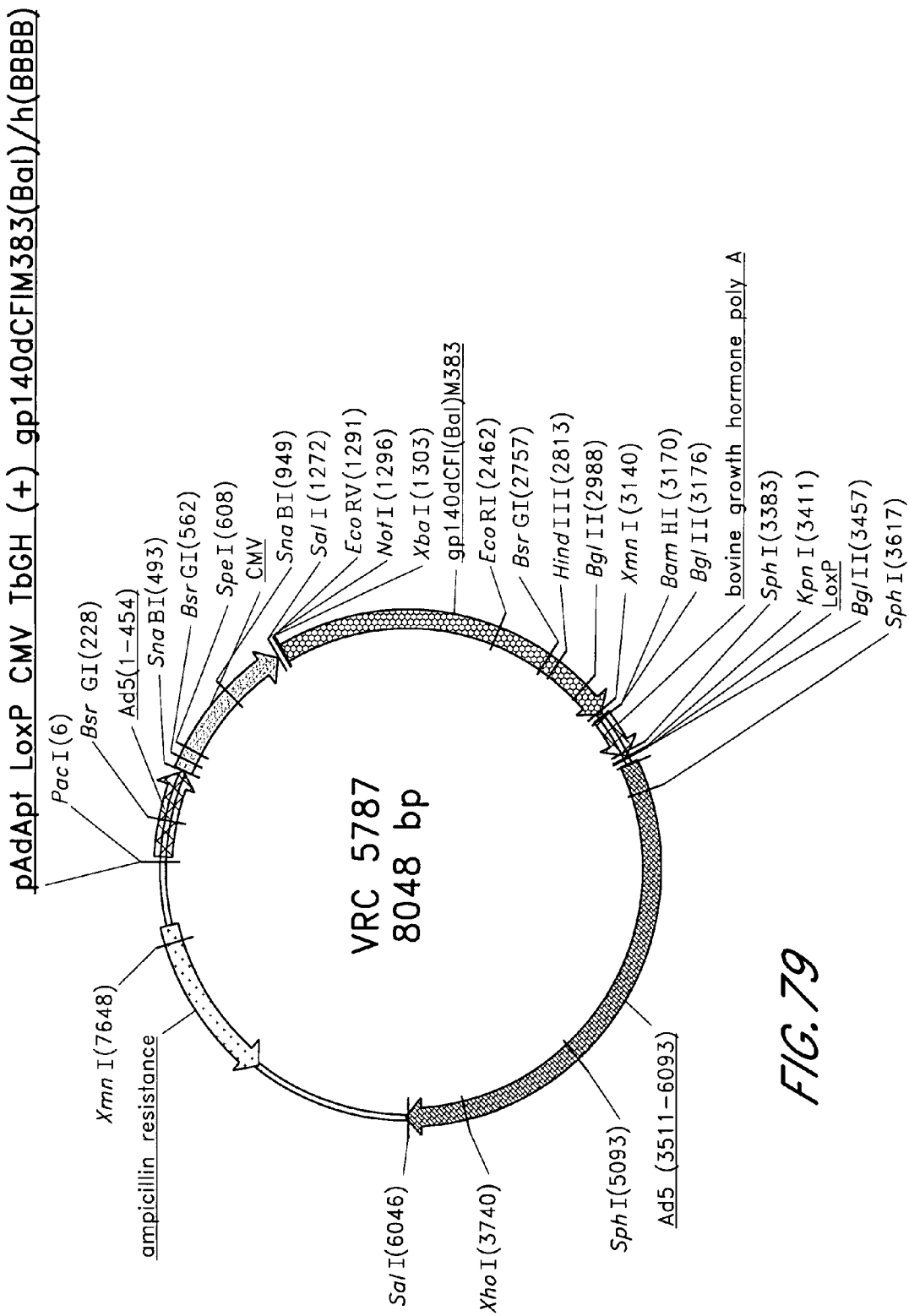
Figure 80:
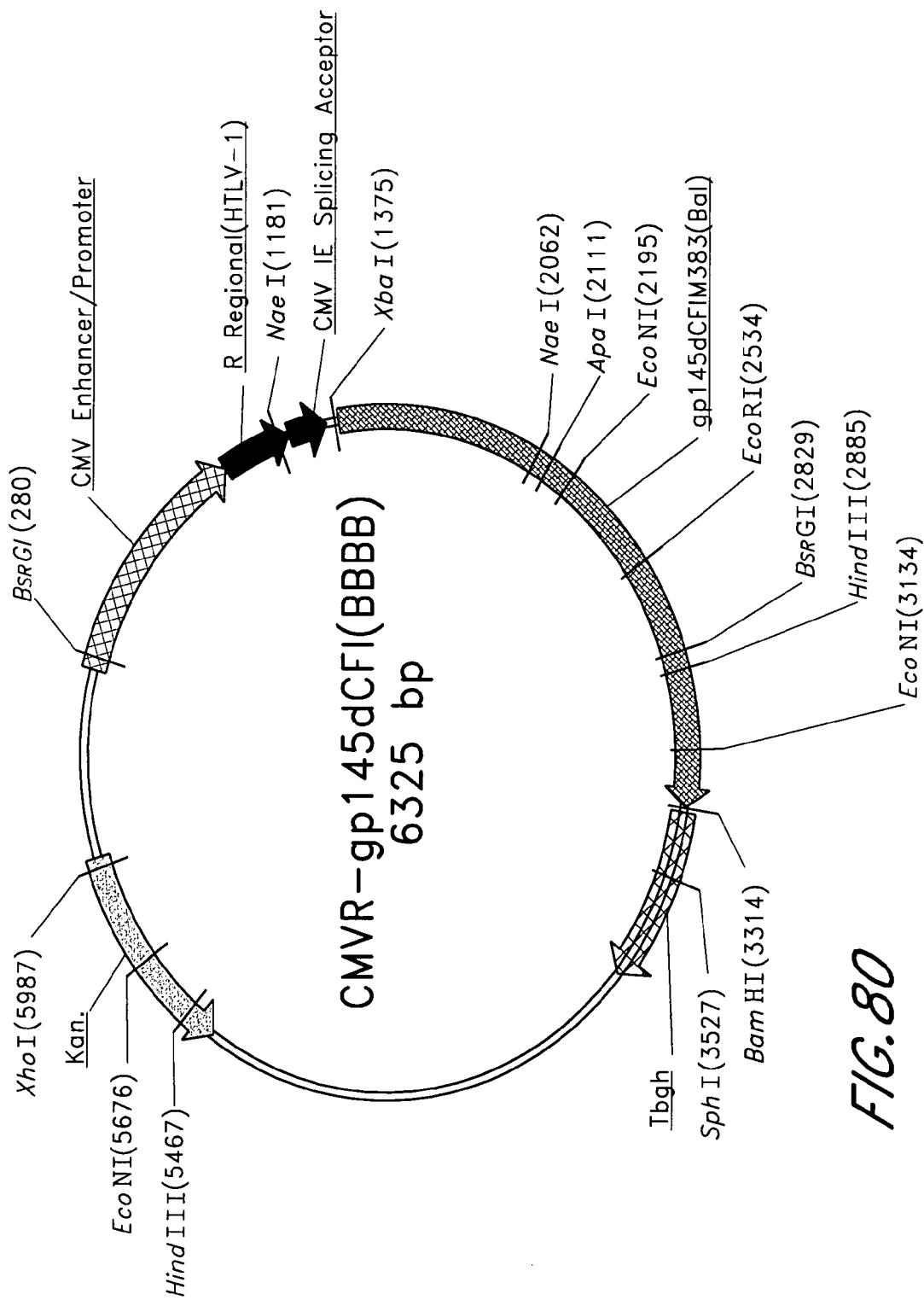
Figure 81:
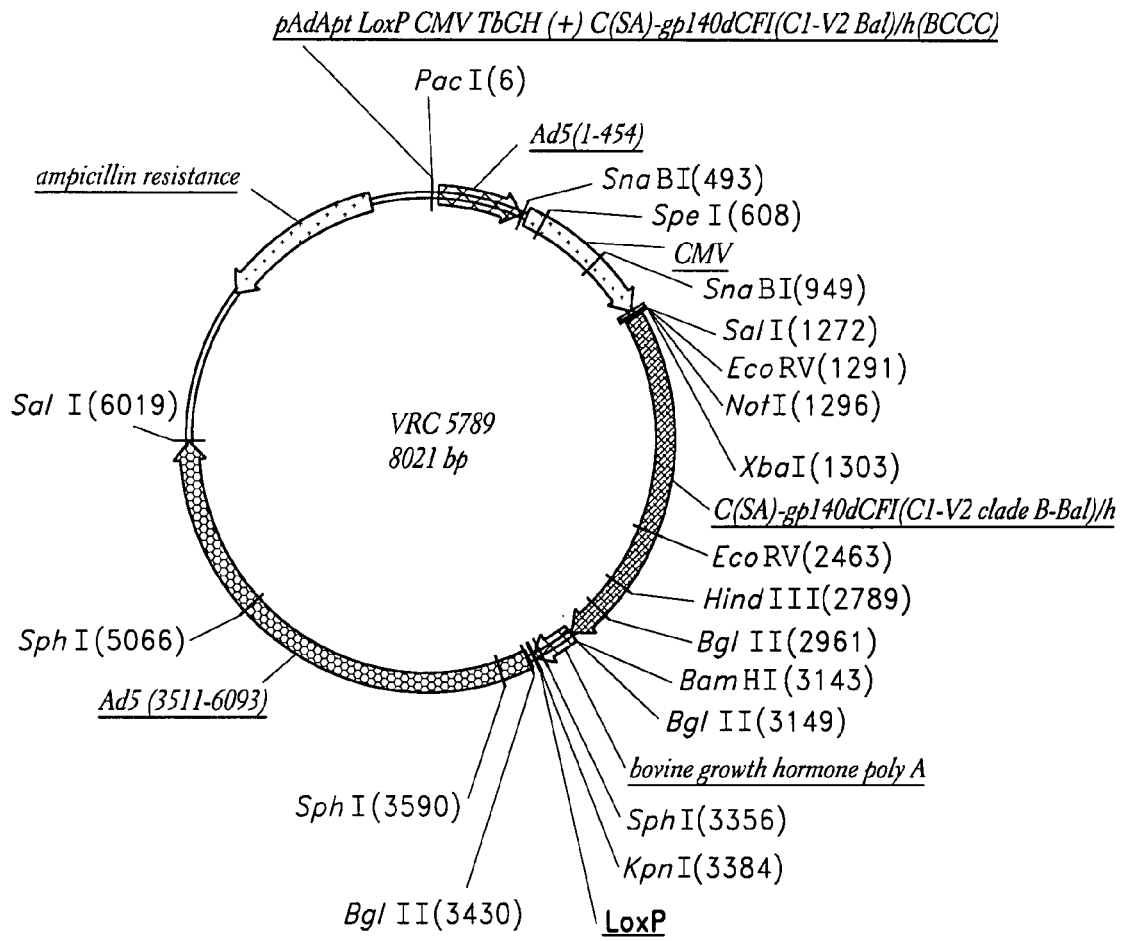
Figure 83:
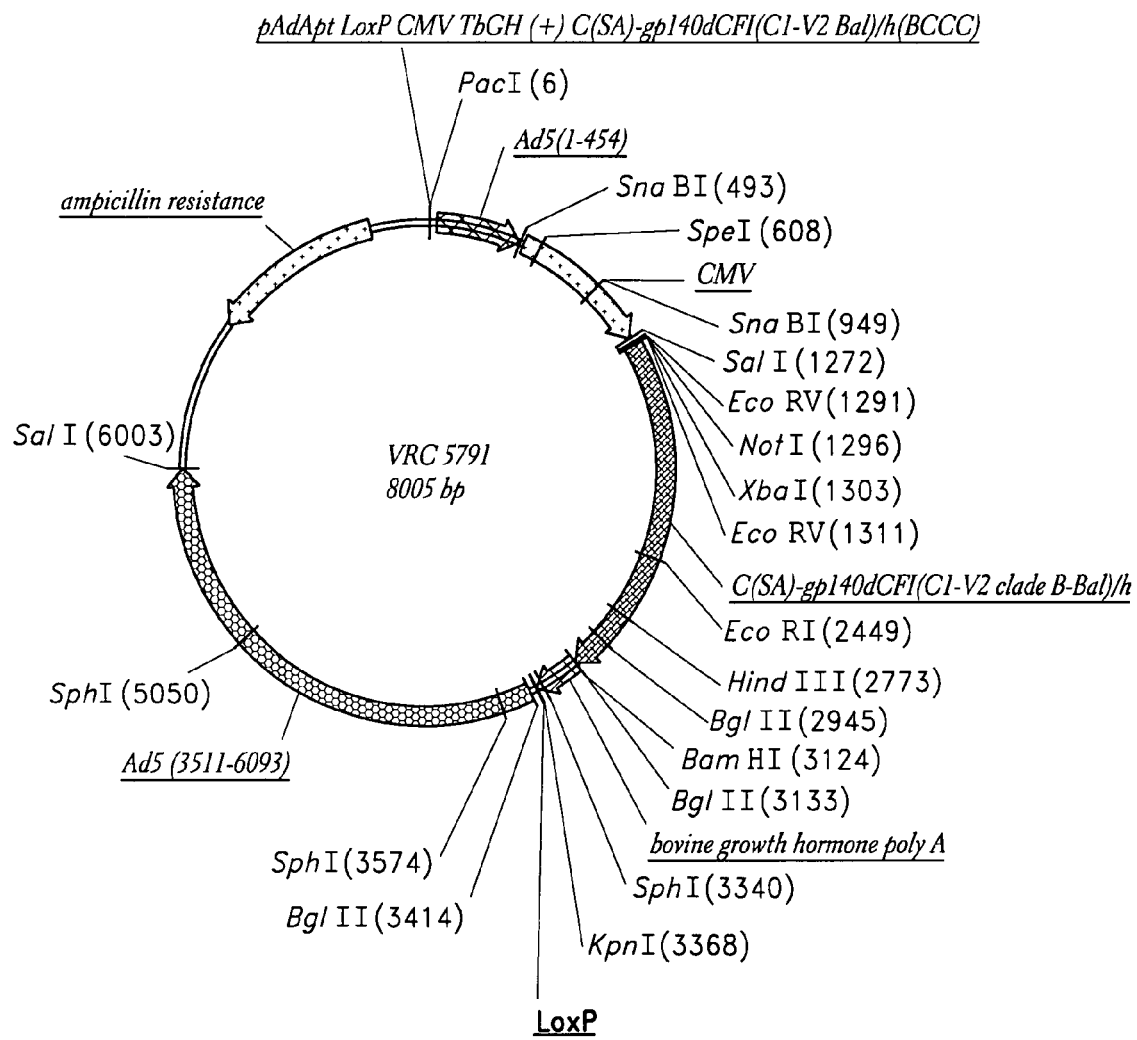
Figure 85:
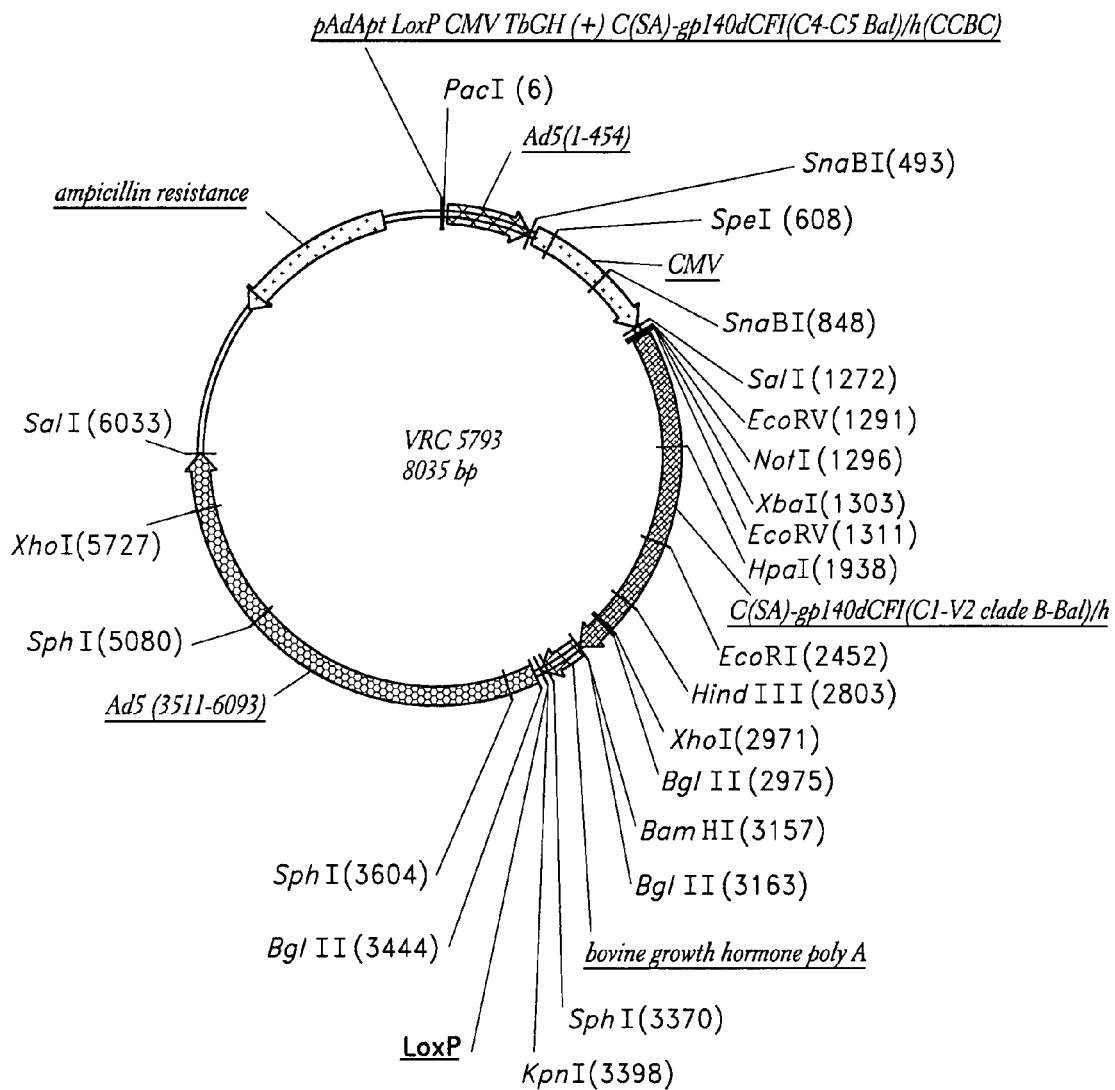

FIG. 73. Adenoviral vector map for VRC 5781.
FIG. 74. Plasmid map for VRC 5782.
FIG. 75. Adenoviral vector map for VRC 5783.
FIG. 76. Plasmid map for VRC 5784.
FIG. 77. Adenoviral vector map for VRC 5785.
FIG. 78. Plasmid map for VRC 5786.
FIG. 79. Adenoviral vector map for VRC 5787.
FIG. 80. Plasmid map for CMVR-gp145ΔCFI(BBBB).
FIG. 81. Adenoviral vector map for VRC 5789.
FIG. 82. Plasmid map for VRC 5790.
FIG. 83. Adenoviral vector map for VRC 5791.
FIG. 84. Plasmid map for VRC 5792.
FIG. 85. Adenoviral vector map for VRC 5793.
FIG. 86. Plasmid map for VRC 5794.

DETAILED DESCRIPTION OF THE PREFERRED EMBODIMENT

Part I

Expanded Breadth of Virus Neutralization after Immunization with a Multiclade Envelope HIV Vaccine Candidate Abstract Although the V3 loop of the human immunodeficiency virus type 1 (HIV-1) envelope (Env) effectively elicits potent neutralizing antibody responses, the specificity of the antibody response is often restricted to T cell line adapted (TCLA) strains and a small subset of primary isolates, limiting its utility for an AIDS vaccine. In this study, we have compared Env immunogens with substituted V3 regions to combinations of strains from different clades and evaluated their ability to expand the breadth of the neutralizing antibody response. When the V3 region from HIV BaL was substituted for HIV HXB2, an effective neutralizing antibody response against several clade B primary isolates was elicited, but it remained restricted to neutralization of mostly clade B isolates. In an attempt to expand this response further, a linear epitope recognized by the broadly neutralizing 2F5 antibody was inserted into V3. A V3 2F5 epitope was identified that bound to 2F5 and elicited a potent 2F5 antibody response as an immunogen, but the antisera neutralized only a lab-adapted strain and not primary isolates. In contrast, combinations of Envs from clades A, B, and C, elicited neutralizing antibodies to a more diverse group of primary HIV-1 isolates. These studies indicate that combinations of Env immunogens, despite the limited reactivity of the V3 from each component, can be used to expand the breadth of the neutralizing antibody response.

Introduction

Significant advances have been made in the development of AIDS vaccine candidates that elicit cell-mediated immune responses, and these responses contribute to natural and vaccine-induced immune protection against disease (reviewed in Letvin, N. L. & Walker, B. D. 2003 Nat Med 9:861-6). At the same time, it is reasonable to expect that broadly cross-reactive and potent neutralizing antibody responses could play a major role in protective immunity to HIV. For example, several human monoclonal antibodies have been identified that can neutralize a broad spectrum of primary isolates (Burton, D. R. et al. 1994 Science 266:1024-7; Conley, A. J. et al. 1994 PNAS USA 91:3348-52; Gauduin, M. C. et al. 1997 Nat Med 3:1389-93; Kessler, J. A. et al. 1997 AIDS Res Hum Retroviruses 13:575-82; Muster, T. et al. 1994 J Virol 68:4031-4; Trkola, A. et al. 1995 J Virol 69:6609-17). These antibodies can be protective if administered at high concentration shortly before viral challenge (Baba, T. W. et al. 2000 Nat Med 6:200-6; Conley, A. J. et al. 1996 J Virol 70:6751-8; Mascola, J. R. et al. 1999 J Virol 73:4009-18; Mascola, J. R. et al. 2000 Nat Med 6:207-10; Parren, P. W. et al. 1995 AIDS 9:F1-F6; Parren, P. W. et al. 2001 J Virol 75:8340-7; Shibata, R. et al. 1999 Nat Med 5:204-10). A variety of factors may determine whether antibodies elicited by envelope (Env) immunogens react with the native trimeric Env glycoproteins sufficiently to neutralize virus. Attempts have been made to modify this glycoprotein to retain its oligomeric native structure in an effort to elicit such antibodies (Barnett, S. W. et al. 2001 J Virol 75:5526-40; Chakrabarti, B. K. et al. 2002 J Virol 76:5357-68; Earl, P. L. et al. 2001 J Virol 75:645-53; Lee, S. A. et al. 2001 Vaccine 20:563-76; Lund, O, S. et al. 1998 AIDS Res Hum Retroviruses 14:1445-50; Schonning, K. et al. 1998 AIDS Res Hum Retroviruses 14:1451-6; Schulke, N. et al. 2002 J Virol 76:7760-76; Srivastava, I. K. et al. 2002 J Virol 76:2835-47; Srivastava, I. K. et al. 2003 J Virol 77:2310-20).

Though it appears that highly conserved epitopes in different HIV-1 strains are accessible to antibodies, it is difficult to elicit antibody responses to them. Among the established broadly neutralizing monoclonal antibodies, the 2F5 epitope is linear in nature and is found in the ectodomain of gp41 (Muster, T. et al. 1993 J Virol 67:6642-7; Purtscher, M. et al. 1994 AIDS Res Hum Retroviruses 10:1651-8; Stiegler, G. et al. 2001 AIDS Res Hum Retroviruses 17:1757-65; Zwick, M. B. et al. 2001 J Virol 75:10892-905). Antibodies to this region have been found rarely in HIV-1 seropositive individuals, indicating that this epitope is poorly immunogenic. Attempts have been made previously to insert the 2F5 epitope into the V3 loop of gp120 to increase Env immunogenicity, without success (Liang, X. et al. 1999 Vaccine 17:2862-72). We have reported modifications of the envelope glycoprotein that increase the antibody response to Env (Chakrabarti, B. K. et al. 2002 J Virol 76:5357-68). A modified form of HIV-1 Env with mutations in the cleavage site, fusion peptide and interhelical regions (ΔCFI), has been shown to improve the antibody response while maintaining its ability to induce virus-specific cytotoxic T lymphocytes. In these vectors and a number of protein immunogens, the V3 region is particularly immunogenic and elicits potent, although restricted, antibody responses.

In this study, we have examined the ability of the V3 loop to elicit broadly neutralizing antibody responses. Two approaches have been taken: 1) introduction of heterologous sequences into the V3 loop, and 2) inclusion of multiple envelopes from different clades in the vaccine. As a model for insertion of heterologous sequences, the 2F5 epitope was analyzed. For the inclusion of multiple V3 Envs, a combination of clades A, B, and C was evaluated. Though the positionally inserted 2F5 epitope in ΔCFI Env elicited antibody against the linear peptide, it did not neutralize primary virus isolates. In contrast, the multiple clade Env immunogen helped to expand the immune response to several strains tested from these alternative clades. The combination of HIV envelope genes from different clades induced neutralizing antibody to a number of unrelated lab-adapted strains and primary isolates. These studies suggest that the V3 loop can contribute to Env antibody immunogenicity, and combination Env immunization can expand the breadth of the neutralizing antibody response in an HIV vaccine candidate.

Materials and Methods

Immunogens. Plasmids encoding CCR5-tropic V3 loops from clades A, B and C were built on the backbone of gp145ΔCFI and gp140ΔCFI versions of the CXCR4-tropic strain HIV HXB2 (GenBank accession number K03455) and the CCR5-tropic strain HIV BaL (GenBank accession number K03455) as described previously (Chakrabarti, B. K. et al. 2002 *J Virol* 76:5357-68). Briefly, to produce a CCR5-tropic version of the envelope glycoprotein (CCR5 gp160/h), the region encoding amino acids 205 to 361 from HIV HXB2 gp160 was replaced with the corresponding region from the HIV BaL strain of HIV-1 (GenBank accession number M68893, with preferred human codon usage) to make it hybrid, HIVHXB/Bal. Synthetic versions of clades A and C gp145ΔCFI and gp140ΔCFI Env glycoprotein were made based on HIV-1 strains 92rw020 (CCR5-tropic, GenBank accession number U51283) and 97ZA012 (GenBank accession number AF286227) following the same approach described above. The fusion domain and the cleavage sequence from amino acids 486-519 and the interspace between H1 (heptad 1) and H2 (heptad 2) from amino acids 576-604 were deleted and the protein was terminated after the codons for aa 690 and aa 664 to make gp145ΔCFI and gp140ΔCFI Env respectively. The fusion domain and the cleavage sequence from amino acids 487-520 and the interspace between H1 and H2 from amino acids 577-605 clade C gp160 were deleted. The protein was terminated after the codons for aa 689 and aa 664 to create a synthetic protein clade C gp145ΔCFI/h and clade C gp140ΔCFI/h respectively. For the 2F5 V3 chimeric Envs, a hybrid envelope gp140ΔCFI B(C-HR2), completely lacking 2F5 (−2F5), was made by replacing the sequence of CCR5-tropic gp140ΔCFI of strain of HIVHXB/Bal from aa 592 to 680 that includes the HR2 (heptad repeat 2) and the monoclonal antibody 2F5 binding region with the corresponding region from clade C gp140ΔCFI that lacks 2F5, aa 592 to 688. The hybrid envelope gp140ΔCFI clade B (C-HR2), −2F5, in HIVHXB/Bal backbone was further modified by deleting GPGRA (aa 309-313) to generate gp140ΔCFIΔGPGRA B(C-HR2), designated -tip -2F5. The minimal and the extended 2F5 epitopes encoding 'LELDKWAS' (SEQ ID NO: 3) and 'KNEQEL-LELDKWAS' (SEQ ID NO: 4) respectively were inserted in the place of GPGRA (SEQ ID NO: 12) in the V3 loop of gp140ΔCFI B(C-HR2), -2F5, by site-directed mutagenesis to form gp140ΔCFI B(C-HR2) 2F5, termed V3 2F5, and gp140ΔCFI B(C-HR2) ext 2F5 or V3 ext2F5 respectively.

Expression analysis of envelope proteins in transfected cells. Expression of Envs was confirmed as described previously by transfection and Western blotting in 293 cells (Chakrabarti B K et al. 2002 *J Virol* 76:5357-68). Binding to soluble CD4 (sCD4) was performed as described previously (Chakrabarti, B. K. et al. 2002 *J Virol* 76:5357-68; Karlsson, G. B. et al. 1998 *J Exp Med* 188:1159-71). The abilities of several monoclonal antibodies, 2F5, 2G12, F105, and IgG1b12, to bind gp140ΔCFI from different clades were determined as described previously (Chakrabarti, B. K. et al. 2002 *J Virol* 76:5357-68). Antibody (5 μg) was used to immunoprecipitate gp140ΔCFI from 100 μl of membrane-free supernatant from 293 cells transfected with the expression vector expressing clade A, clade B or clade C gp140ΔCFI. The same volume of supernatant from cells transfected with empty vector was used as a control. Antibodies were obtained from the AIDS Research and Reference Reagent Program, National Institutes of Health. The binding of HIV-1 IgG to either R5/B 140ΔCFI or different mutants was measured by ELISA. Briefly, Immulon 2HB ELISA plates (Thermo Labsystems, Franklin, Mass.) were coated with 100 μl/well of Lectin Galanthus Nivalis (Sigma, St. Louis, Mo.) (10 μg/ml in PBS) overnight at 4° C. The plates were blocked with 200 μl of PBS containing 10% FBS for 2 hours at room temperature, and washed twice with PBS containing 0.2% TWEEN™-20 (PBS-T). Samples were added and developed as described in PART II below. To detect the 2F5 or V3 antibodies in sera of immunized guinea pigs, ELISA plates were coated with either 100 μl of 2F5 peptide, KNEQELLELDKWAS (10 μg/ml) (SEQ ID NO: 4), or 100 μl of V3 peptide, 'TRP-NNNTRKSIHIGPGRAFYTTGEIIGDIRQAH' (SEQ ID NO: 13), overnight at 4° C. The peptide solution was removed from the wells and blocked with 200 μl of PBS containing 10% FBS for 2 hours at room temperature. The plates were washed twice with PBS containing 0.2% TWEEN™ 20 (PBS-T), and then the sera from immunized guinea pigs from different groups were added with 3-fold dilutions for 1 hour.

Immunizations. Six-week-old female Huntley guinea pigs were injected intramuscularly with 500 μg of purified plasmid DNA encoding the gp145ΔCFI forms of the relevant immunogens in 400 μl of normal saline. For multiclade A, B, and C envelope immunization, one-third of total 500 μg of DNA was used for each envelope expressing plasmid. For each plasmid DNA, a group of four guinea pigs was injected three times at intervals of 2 weeks. The guinea pigs were bled 2 weeks after the last injection, and sera were collected and stored at 4° C. The guinea pigs received a boost with replication-defective recombinant adenovirus (ADV) encoding the gp140ΔCFI form of the same immunogen as described previously (Sullivan, N. J. et al. 2000 *Nature* 408:605-9; Xu, L. et al. 1998 *Nat Med* 4:37-42; Yang, Z. et al. 1998 *Science* 279:1034-7) and were bled 2 weeks after ADV injection.

HIV-1 Viruses. HIV-1 primary isolates, and the T-cell line adapted HIV MN and HIV IIIB, were obtained from NIH AIDS Research and Reference Reagent Program except as noted below. Primary isolates 6101 (previously called P15) and 1168 are CCR5 using clade B HIV-1 strains described previously (Bures, R. et al. 2000 *AIDS Res Hum Retroviruses* 16:2019-35). DU151, DU123 and S007 are clade C viruses that have also been previously described (Bures R et al. 2002 *J Virol* 76:2233-44). TV1 (clade C) was provided by Estrelita Janse Van Rensburg (University of Stellenbosch, South Africa). DJ263 is a clade A virus that was provided by investigators from the U. S. Military HIV Research Program. All primary viral stocks were prepared and titrated in PHA and IL-2 stimulated human peripheral blood mononuclear cells (PBMC). Viruses BL01 and BR07 were provided by Dana Gabuzda of the Dana-Farber Cancer Institute (Ohagen, A. et al. 2003 *J Virol* 77:12336-45). Both are chimeric infectious molecular clones of NL4-3 that contain the near full-length env genes from HIV-1 strains indicated. After initial plasmid transfection of 293 cells, these viruses were expanded in PBMC as described above.

Neutralizing antibody assays. Two assays for neutralization were used. Neutralization of a BaL isolate was measured in PBMC by using a reduction in p24 Gag antigen synthesis as described previously (Bures, R. et al. 2000 *AIDS Res Hum Retroviruses* 16:2019-35). Briefly, 500 50% tissue culture infective doses of virus were incubated with various dilutions of test samples (serum) in triplicate for 1 h at 37° C. in 96-well U-bottom culture plates. PHA-PBMC were added and incubated for one day. The cells were then washed three times with growth medium and resuspended in 200 μl of fresh growth medium. Culture supernatants (25 μl) were collected twice daily thereafter and mixed with 225 μl of 0.5% Triton X-100. The 25 μl of culture fluid removed each day was replaced with an equal volume of fresh growth medium. Concentrations of p24 Gag antigen were measured in an antigen capture ELISA as described by the supplier (DuPont/NEN Life Sciences, Boston, Mass.). Concentrations of p24 in virus control wells (virus plus cells but no test serum) were determined for each harvest day. Concentrations in all remaining wells were determined for a harvest day that corresponded to a time when p24 production in virus control wells was in an early linear phase of increase that exceeded 3 ng/ml, which is when optimum sensitivity is achieved in this assay (Zhou, J. Y. & Montefiori, D. C. 1997 *J Virol* 71:2512-7). The limit of detection in the p24 ELISA was 0.1 ng of p24/ml. Neutralization titers are given as the reciprocal of the minimum serum dilution (calculated prior to the addition of cells) that reduced p24 synthesis by 80% relative to a negative control serum sample from a healthy, HIV-1-negative individual. Neutralization assay for TCLA strains were performed in either MT-2 cells (HIV IIIB and HIV MN) by using neutral red to quantify the percentage of cells that survived virus-induced killing (Montefiori, D. C. et al. 1988 *J Clin Microbiol* 26:231-5). Briefly, 500 50% tissue culture infective doses of virus were incubated with multiple dilutions of serum samples in triplicate for 1 h at 37° C. in 96-well flat-bottom culture plates. Cells were added and the incubation continued until most but not all of the cells in virus control wells (cells plus virus but no serum sample) were involved in syncytium formation (usually 4 to 6 days). Cell viability was quantified by neutral red uptake as described (Montefiori, D. C. et al. 1988 *J Clin Microbiol* 26:231-5). Neutralization titers are defined as the reciprocal serum dilution (before the addition of cells) at which 50% of cells were protected from virus-induced killing. A 50% reduction in cell killing corresponds to an approximate 90% reduction in p24 Gag antigen synthesis in this assay (Bures, R. et al. 2000 *AIDS Res Hum Retroviruses* 16:2019-35). Each set of assays included a positive control serum that had been assayed multiple times and had a known average titer. V3-specific neutralizing antibodies were assessed by incubating diluted serum samples (diluted with an equal volume of phosphate-buffered saline, pH 7.4) for 1 h at 37° C. in the presence and absence of V3 peptide (50 μg/ml). Titers of neutralizing antibodies were then determined in either the PBMC assay (in the case of primary isolates) or the MT-2 cell assay (in the case of HIV IIIB and HIV MN) by using neutral red as described above.

The alternative assay used a single round intracellular p24-antigen flow cytometric HIV-1 neutralization assay has been described previously (Mascola, J. R. et al. 2002 *J Virol* 76:4810-21). Briefly, 40 μl of virus stock (multiplicity of infection, approximately 0.1) was incubated with 10 μl of heated inactivated guinea pig serum, or with 10 μl of control antibody. After incubation for 30 min at 37° C., 20 μl of mitogen stimulated CD8 depleted PBMC ($1.5\times10^5$ cells) were added to each well. These T-cells were maintained in IL-2 culture medium containing 1 μM indinavir, and the cells were fed on day 1 with 150 μl of IL-2 culture medium. One day after infection, cells were stained for intracellular p24-Ag using the KC57 (Beckman Coulter, Inc.) anti-p24 antibody, followed by quantitation of HIV-1 infected cells by flow cytometry. Live cells initially gated by forward and side scatter were analyzed for p24-Ag positive cells. After forward and side scatter gating, 50,000 events were counted. Final quantitation of p24 positive PBMC was done by subtraction of background events in mock-infected cells (typically less than 10 cells per 50,000 events counted). The percent neutralization was derived by calculating the reduction in the number of p24-Ag positive cells in the test wells with immune sera, compared to the number of p24-Ag positive cells in wells containing pre-immune sera from the corresponding animal. All assays included additional control wells with commercial pooled guinea pig sera (Gemini Bio-Products, Woodland, Calif.), as well as positive control wells containing well characterized monoclonal or polyclonal neutralizing antibodies. Standard operating procedures prescribed the acceptable positive and negative control values, and all data shown are from assays that met these criteria.

Peptide competition assays were done in the same assay format, except that the V3 peptide was added to the serum 30 minutes before virus was added. The concentration of peptide reported was that present when peptide, serum and virus were incubated together. The V3 peptides based on HIV-1 strains BaL, ZA12 and RW20 (matching the vaccine strains), and a scrambled V3 peptide, was made as a 23mer (IGPGRATRP-NNNFYTTGTRKSIH) (SEQ ID NO: 14) by SynPep (Dublin, Calif.). The HIV IIIB V3 peptide (a 24 mer) was purchased from Sigma-Aldrich. The scrambled V3 peptide was included as a control in all assays. Additional controls, a mixture of 22 peptides (15 mers overlapping by nine spanning the Ebola (Zaire) viral glycoprotein sequence), were used to confirm specificity of V3 peptide inhibition.

Results

Figure 1A:
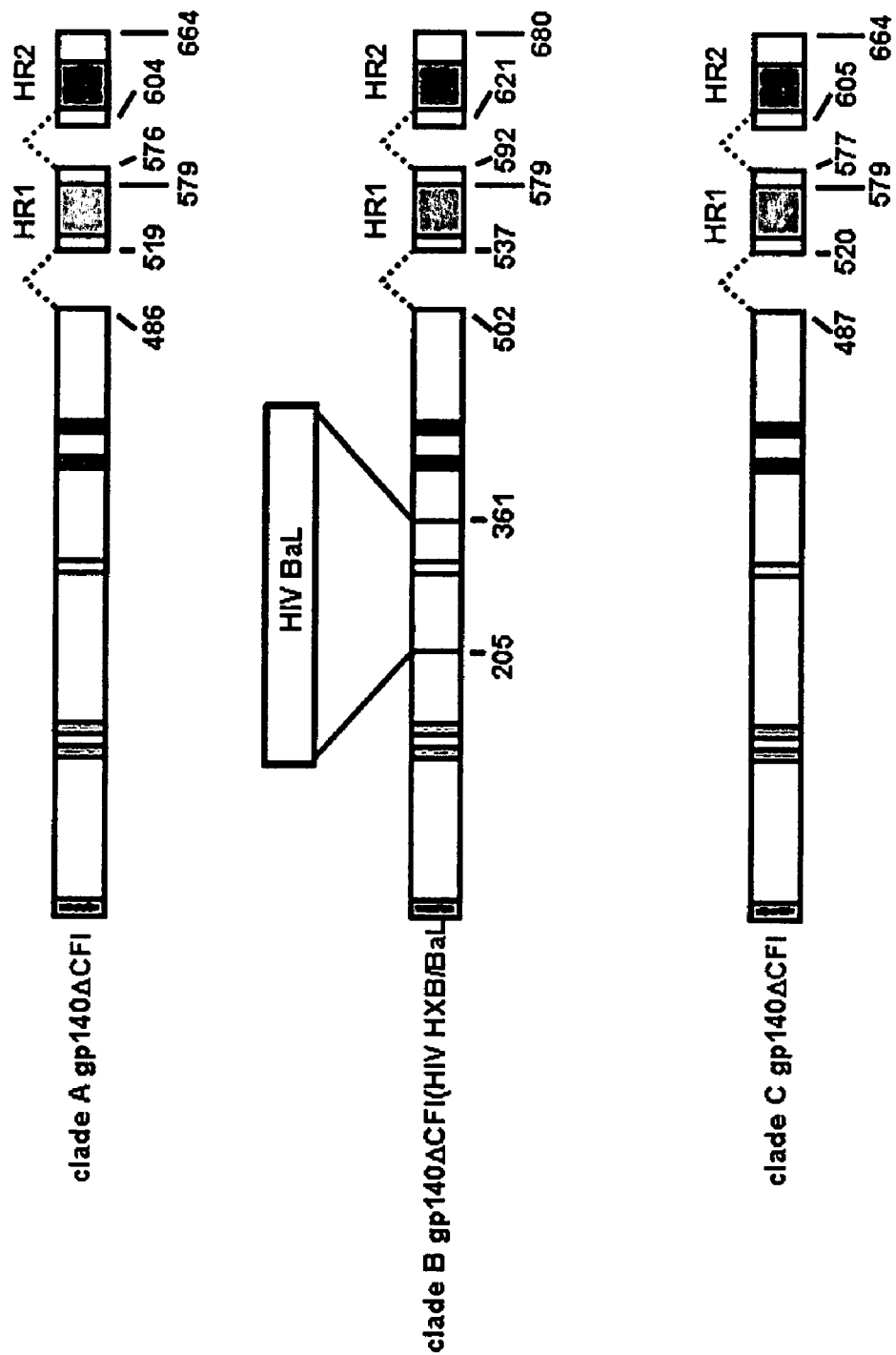
FIG. 1. Schematic representation of HIV Env vectors with V3 region replacements. A. The CXCR4-tropic HIV HXB2, a clade B gp140ΔCFI, was made as described previously (Chakrabarti, B. K. et al. 2002 *J Virol* 76:5357-5368). Most divergent region including the V3 regions, from HIV HXB2 was replaced by the similar region of HIV BaL to make R5 tropic clade B HIV HXB/BaL. The gp140ΔCFI of both clade A and clade C were also made as described in the Materials and Methods (see PART I). B. Expression of the indicated vectors was confirmed by transfection in 293 cells and Western blot analysis. The Env was detected by Western blot with polyclonal antibody against gp160 (Intracel, Rockville, Md.) at a dilution of 1:3000.
Figure 1B:
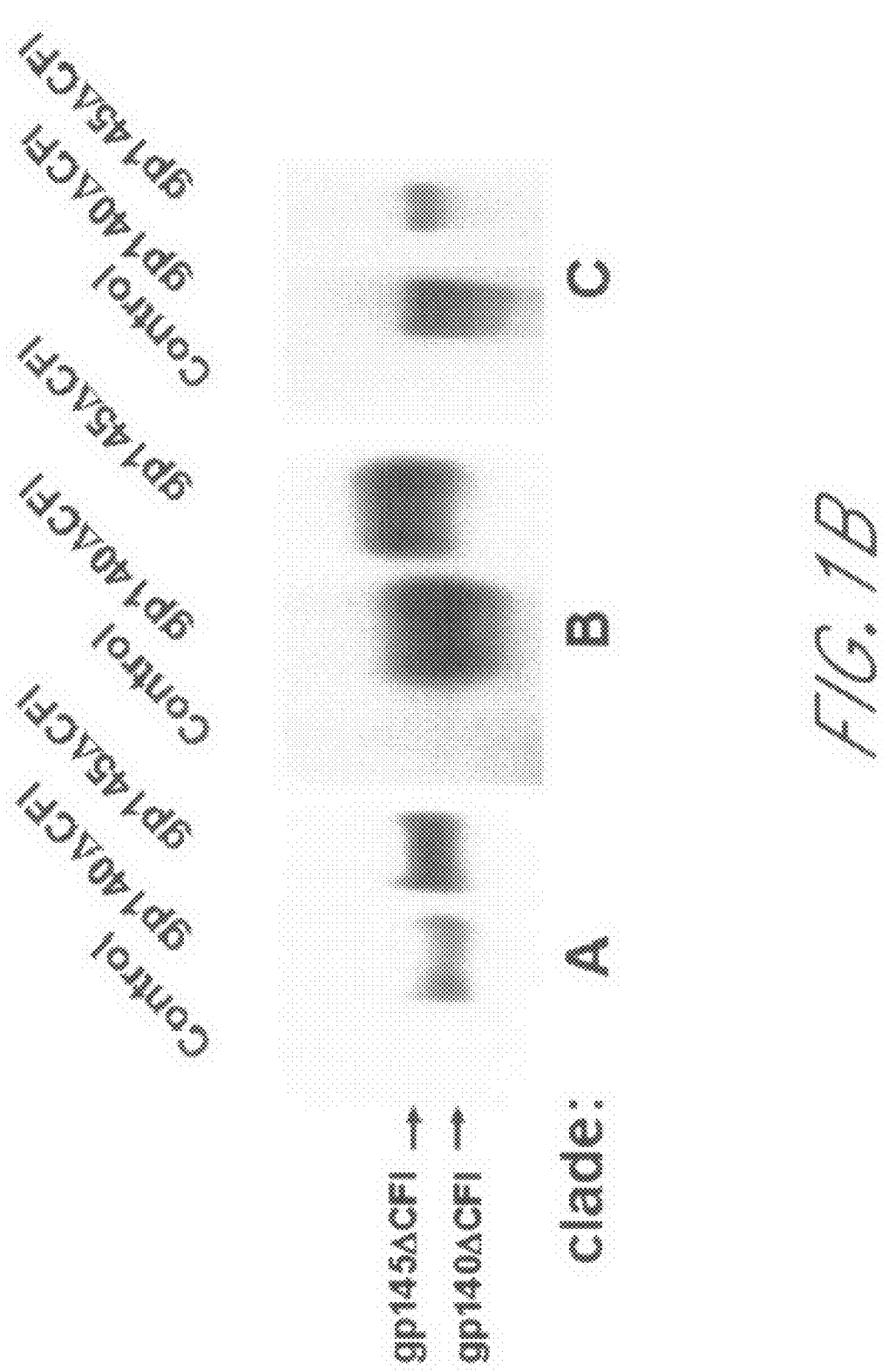
Figure 2A:
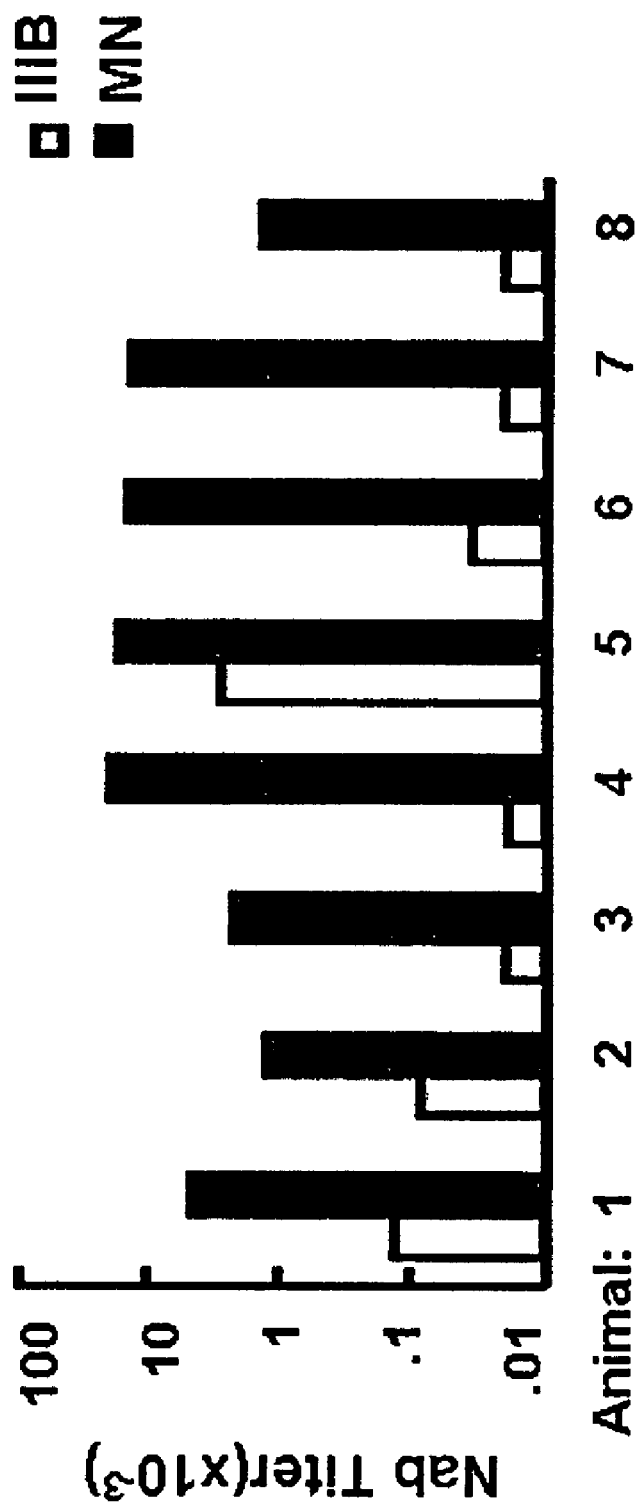
FIG. 2. Induction of neutralizing antibodies by chimeric Env with V3 region substitutions. A. Neutralizing antibody activity from guinea pigs immunized with HIV HXB2/BaL gp140ΔCFI. Immune sera were tested for their ability to inhibit HIV IIIB (open bars) and HIV MN (filled bars). The neutralizing antibody titer is defined as the dilution of sera yielding 50% virus neutralization in the MT2 assay killing (Montefiori, D. C. et al. 1988 *J Clin Microbiol* 26:231-5). B. The same sera shown in FIG. 2A were tested against HIV BaL. The data represent the % neutralization of the HIV BaL by these sera at 1:4 dilution.
Figure 2B:
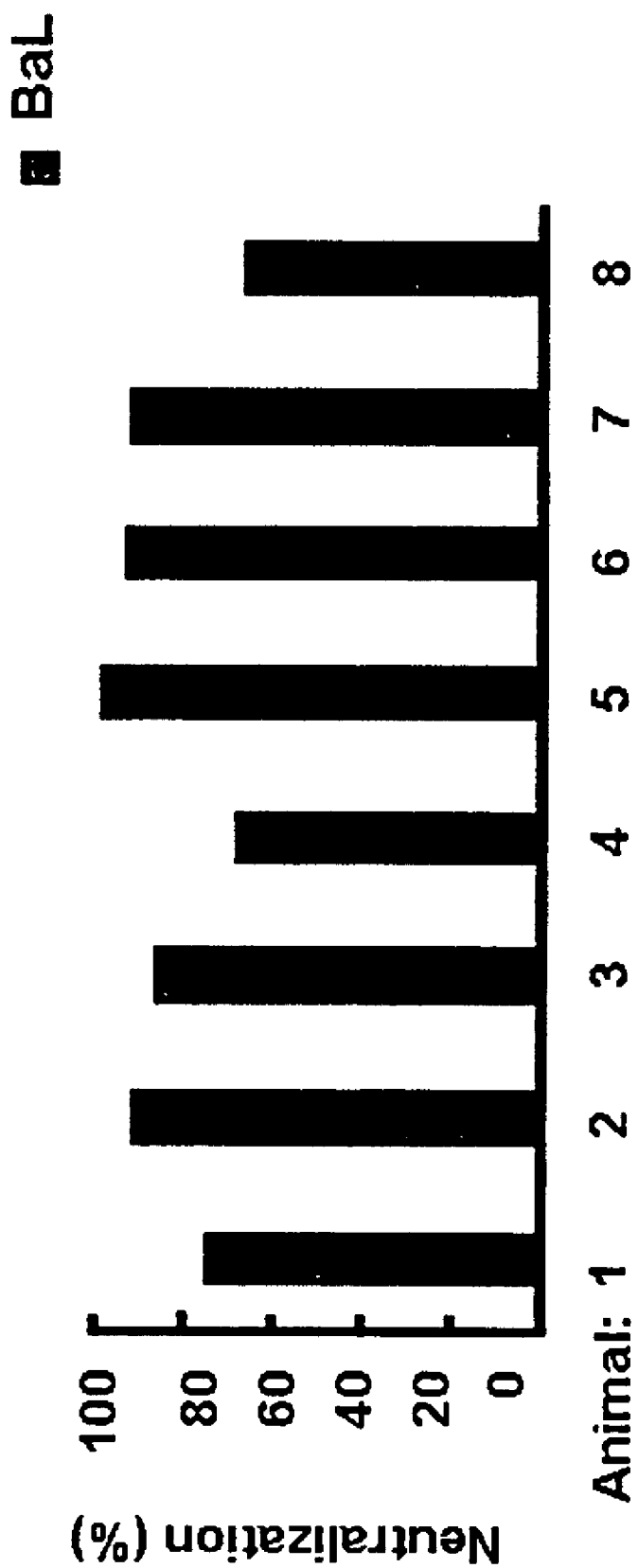
Figure 3B:
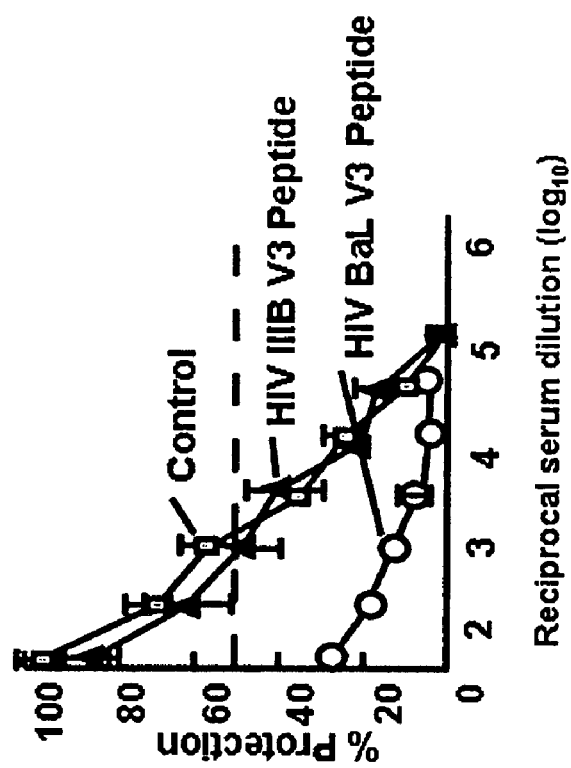
FIG. 3. Titer and specificity of neutralizing antibodies generated in guinea pigs after immunization with gp145/140ΔCFI Envs. A. V3-specific neutralization of HIV BaL was measured in peripheral blood mononuclear cells (PBMC) using serum samples that were pre-incubated in the presence and absence of different V3 peptides as described previously (Bures, R. et al. 2000 *AIDS Res Hum Retroviruses* 16:2019-35). Sera were tested at 1:5 dilution in the PBMC assay. B. V3 peptide-specific neutralizing activity induced by gp145/140ΔCFI of HIV BAL was detected by a reduction in the titer of HIV MN-specific neutralizing antibodies in the presence of either HIV IIIB or HIV BAL V3 peptides compared to the untreated control. Assays were performed in MT2 cells as described in Materials and Methods section of PART I (Montefiori, D. C. et al. 1988 *J Clin Microbiol* 26:231-5). The dashed line corresponds to a 50% cut-off considered positive for neutralization.
Figure 3A:
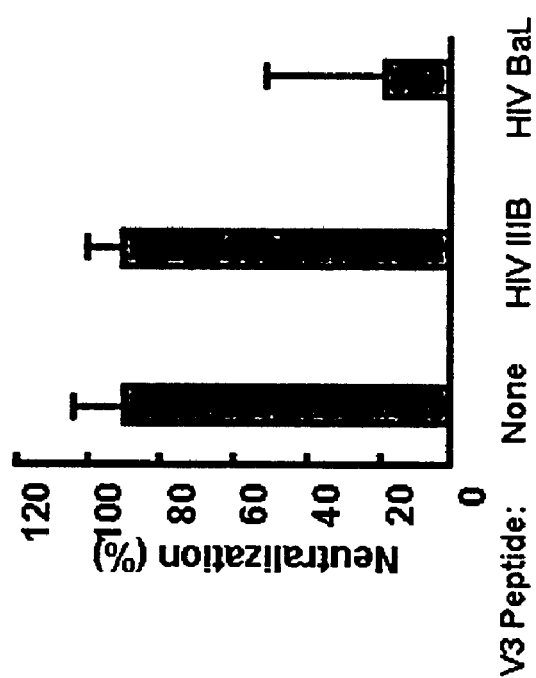

Generation of V3 loop Modified Env Immunogens. To develop HIV Env vaccines with alternative V3 specificities, modifications of a previous clade B HIV-1 prototype strain (Chakrabarti, B. K. et al. 2002 *J Virol* 76:5357-68) containing ΔCFI mutations were made. Replacements of the V3 loop were made at the junction of highly conserved sites at the base of C2 and C4. Specifically, the V3 loop of HIV HXB2 was replaced with that of a CCR5-tropic strain, HIV BaL (FIG. 1A). Expression of these envelope glycoproteins was confirmed in transfected 293 cells as visualized by Western blot analysis (FIG. 1B). As with earlier prototypes (Chakrabarti, B. K. et al. 2002 *J Virol* 76:5357-68), the gp140ΔCFI, which lacks the transmembrane domain, was readily detected in the supernatant, indicating that it could give rise to soluble antigen.

Induction of neutralizing antibody responses by Env immunogen, HIV HXB/Bal. Sera from guinea pigs immunized with the HIV HXB/BaL gp140ΔCFI immunogen were able to neutralize laboratory-adapted strains HIV MN, to a lesser extent, HIV IIIB (FIG. 2A) and CCR5-tropic HIV-1 BaL (FIG. 2B). In contrast, sera from guinea pigs immunized with the parental HIV HXB gp140ΔCFI were not able to neutralize these viruses. It was therefore possible to generate neutralizing antibodies against HIV BaL by inserting the V3 loop of this virus in place of the HIV HXB2 V3 loop that existed in the gp140ΔCFI immunogen. To determine whether the neutralizing activity was mediated by anti-V3 antibodies, competition assays were performed using peptides corresponding to the V3 loop of either HIV BaL or HIV IIIB. This analysis revealed that the antibody-mediated neutralization of HIV BaL was largely V3-dependent (FIG. 3A), as it was inhibited by the HIV BaL but not by the HIV IIIB V3 peptide (FIG. 3A). Neutralization of HIV MN by sera from guinea pigs immunized with parental HIV HXB/BaL gp140ΔCFI was also shown to be V3 dependent (FIG. 3B).

Figure 4A:
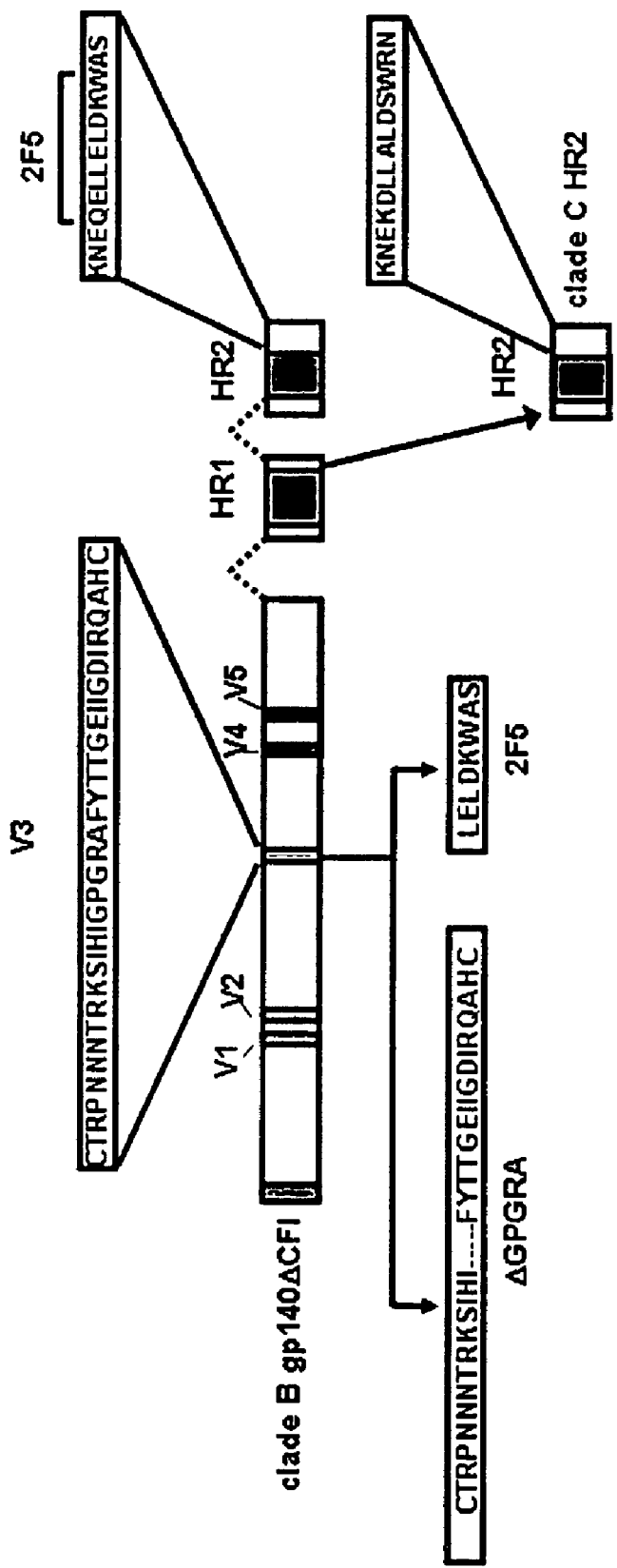
FIG. 4. Schematic representation and expression of different 2F5/V3 mutations in HIV HXB/BaL ΔCFI Envs. A. Schematic representation of gp145ΔCFI derived from clade B HIV HXB/BaL with 2F5 epitopes expressed in V3. Functional domains and major structural motifs are indicated, as previously described (Chakrabarti, B. K. et al. 2002 *J Virol* 76:5357-5368). V1, V2, V3, and V4 refer to the respective variable regions, and the sequences of the relevant V3 loops are shown. Heptad repeat-2 (HR-2), the coiled-coil peptide sequence upstream of the transmembrane domain in R5/clade B envelope, was replaced by the similar region from the clade C Env. The nucleotide sequence corresponding to the amino acids at the tip of V3 (GPGRA, SEQ ID NO: 12) was replaced by nucleotide sequences corresponding to the polypeptide containing either the minimal 2F5 epitope or by nucleotide sequences corresponding to the polypeptide containing the extended 2F5 epitope.
Figure 4B:
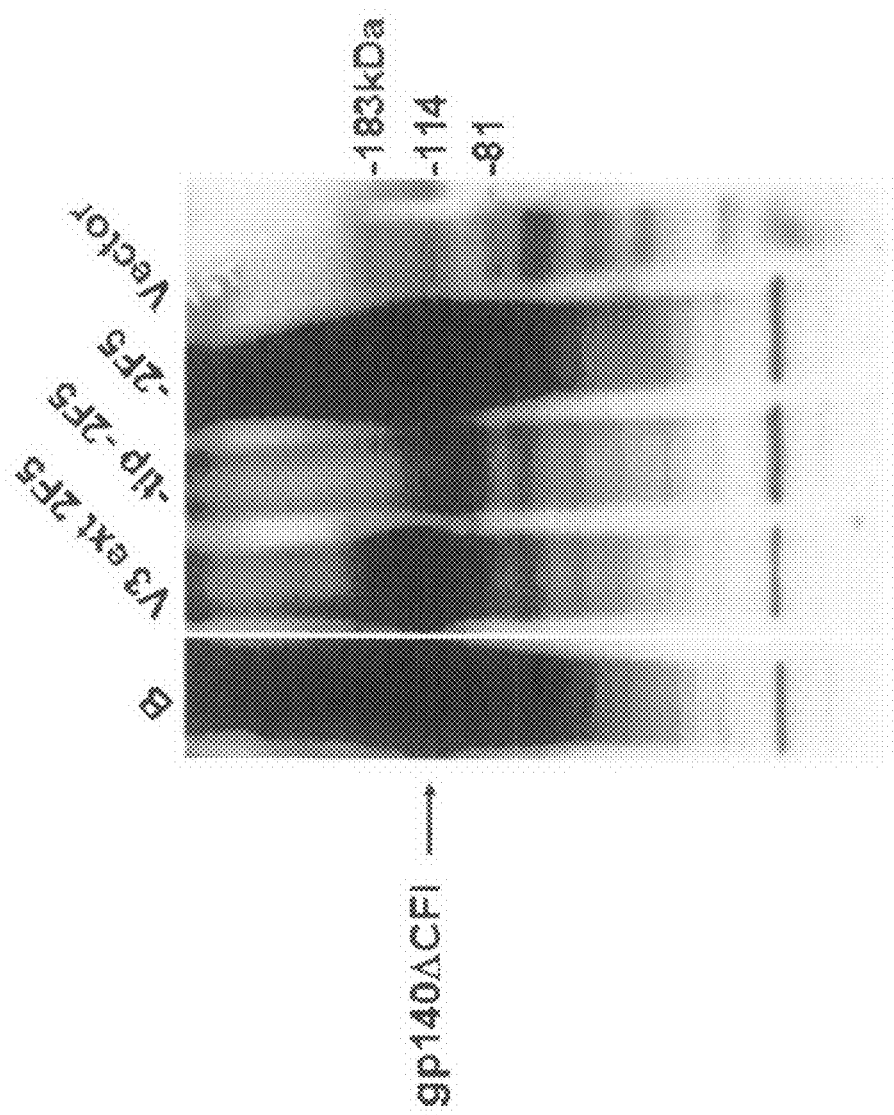

Insertion of the 2F5 epitope into the V3 region. Because the breadth of neutralization by these V3 substitutions remained limited, we asked whether it was possible to insert an epitope into the V3 region that was recognized by a broadly neutralizing antibody. The linear epitope for the antibody, 2F5, represents such a well-defined peptide sequence. A modification was made in the ectodomain of gp41, replacing the clade B HR2 (heptad repeat 2) with the homologous clade C HR2 (heptad repeat 2), which lacks the sequence that is recognized by 2F5 monoclonal antibody, termed -2F5 (FIG. 4A). In this way, the effect of the epitope for 2F5 in the V3 region alone could be assessed. A mutant V3 loop sequence was prepared in which the sequence for 2F5 epitope replaced native V3 sequence at the tip of the V3 loop, designated V3 2F5. The tip of V3, GPGRA (SEQ ID NO: 8), was deleted in another version, -tip -2F5, as a negative control (FIG. 4A). The minimal peptide that is recognized by 2F5 antibody, defined previously (Muster T et al. 1994 *J Virol* 68:4031-4), as well as an extended amino acid sequence more recently recognized (Zwick M B et al. 2001 *J Virol* 75:10892-905), were inserted in the B (C-HR2), V3 ext2F5. Expression of the 2F5 epitope inserted in V3 was confirmed in transfected 293 cells by Western blot analysis. The expression level of these V3 derivatives varied, depending on the presence of the GPGRA tip sequence (FIG. 4B). The expressed protein bearing the 2F5 epitope in mutant V3 reacted with monoclonal antibody 2F5 by ELISA and the gp140ΔCFI B (C-HR2) with the extended 2F5 epitope sequence, V3 ext 2F5, showed 20- to 30-fold higher reactivity than the parental clade B gp140ΔCFI (FIG. 4C, left panel). The various mutant V3's with 2F5 epitope sequences in gp140ΔCFI envelopes reacted similarly with HIV-1 IgG (FIG. 4C, right panel). It was therefore possible to increase the antigenicity of the 2F5 epitope by insertion of these sequences in the correct position of the V3 loop.

Immunogenicity of the 2F5 V3 loop mutants. Guinea pigs were immunized with plasmid DNA and boosted with adenoviral vectors encoding these 2F5 epitopes inserted into V3. The wild-type gp140/145 ΔCFI expression vectors did not elicit antibodies that bound to the peptide containing the 2F5 epitope, similar to the B (C-HR2),-2F5, negative control that lacked the sequence altogether (FIG. 5A, B). Similarly, the vectors that encoded the amino acid sequence for the minimal 2F5 epitope (V3 2F5), despite their ability to bind 2F5 antibodies, did not elicit a measurable 2F5 like antibody response. In contrast, the gp140☐CFI B (C-HR2) with the extended sequence for 2F5 region (V3 ext 2F5) induced the production of antibodies in guinea pigs that could recognize the peptide containing the sequence for extended 2F5 epitope (FIG. 5A, B). These results indicate that insertion of the appropriate sequence for 2F5 epitope in V3 renders this epitope immunogenic.

To determine whether these antisera could inhibit diverse HIV isolates, neutralization assays were performed. These antibodies showed substantial inhibition of a CXCR4-tropic HIV IIIB isolate. However, they failed to inhibit replication of the CCR5-tropic HIV BaL or HIV SF162 isolates (FIG. 5C), indicating that these antibodies were not broadly neutralizing.

Figure 6A:
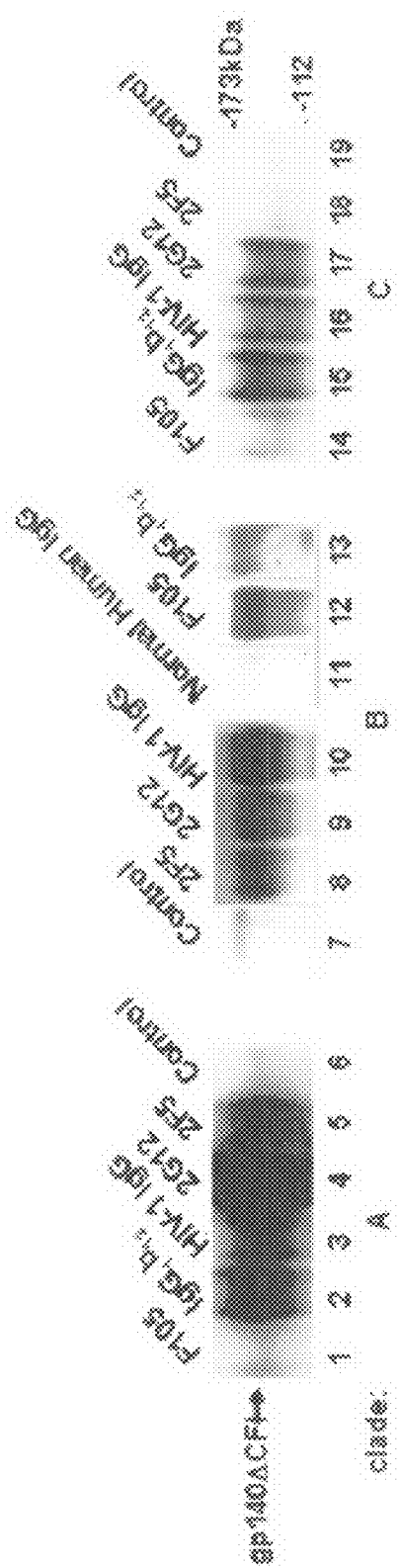
Figure 6B:
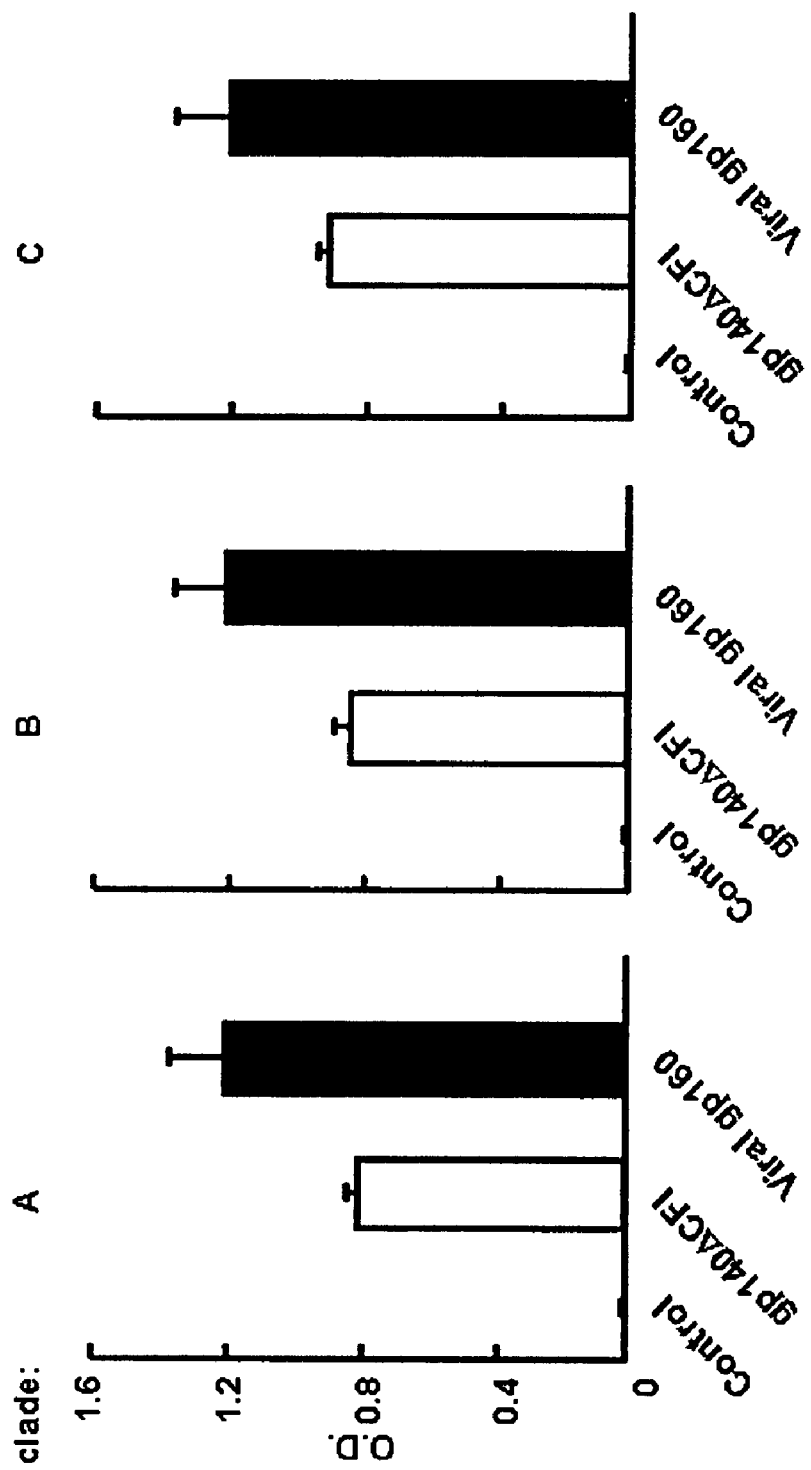

Expression and characterization of multiclade Env immunogens. Plasmid expression vectors encoding clade A and clade C gp140/145ΔCFI proteins were synthesized using the same modified codon preferences and mutations applied to the clade B vectors. Their expression was confirmed in transfected 293 cells by immunoprecipitation with well-defined broadly neutralizing monoclonal antibodies such as 2F5, 2G12, F105, and IgG1b12, followed by Western blot analysis (FIG. 6A). Reactivity of these antibodies with clades A, B, and C varied in terms of recognition and specificity (FIG. 6A) as expected from previous analyses with these antibodies across clades (Moore, J. P. et al. 1994 *J Virol* 68:8350-64; Trkola, A. et al. 1996 *J Virol* 70:1100-8; Kostrikis, L. G. et al. 1996 *J Virol* 70:445-58). Env derived from clades A and B reacted with 2F5 antibody, in contrast to clade C, which showed no detectable reactivity by immunoprecipitation and Western blotting. In contrast, clades A and C Env readily interacted with IgG1b12, whereas a clade B Env showed weaker reactivity with the same monoclonal antibody. All Envs showed similar binding to the monoclonal antibody, 2G12. The gp140ΔCFI forms that lack the transmembrane domain were readily detected in the supernatant (FIG. 6A, B), indicating that they gave rise to soluble antigen. To further assess whether these glycoproteins retained conformational structures relevant to Env function, their ability to interact specifically with its receptor, CD4, was assessed. Compared to negative control supernatants, these Envs readily bound to soluble CD4 produced from transfected 293 cells (FIG. 6B), as previously described for clade B (Chakrabarti, B. K. et al. 2002 *J Virol* 76:5357-68), confirming that the CD4 binding site determinants were intact.

Figure 7A:
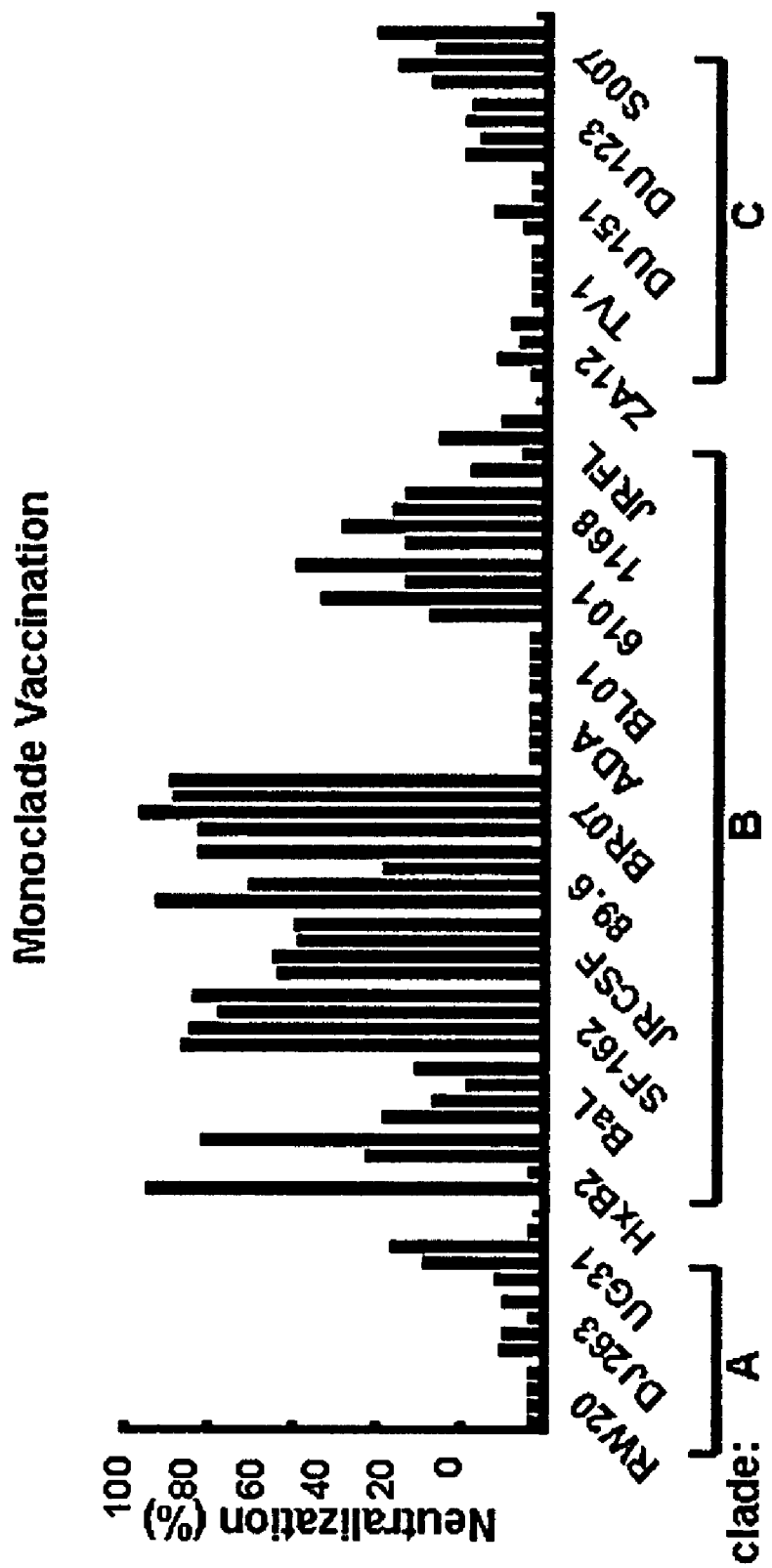
Figure 7B:
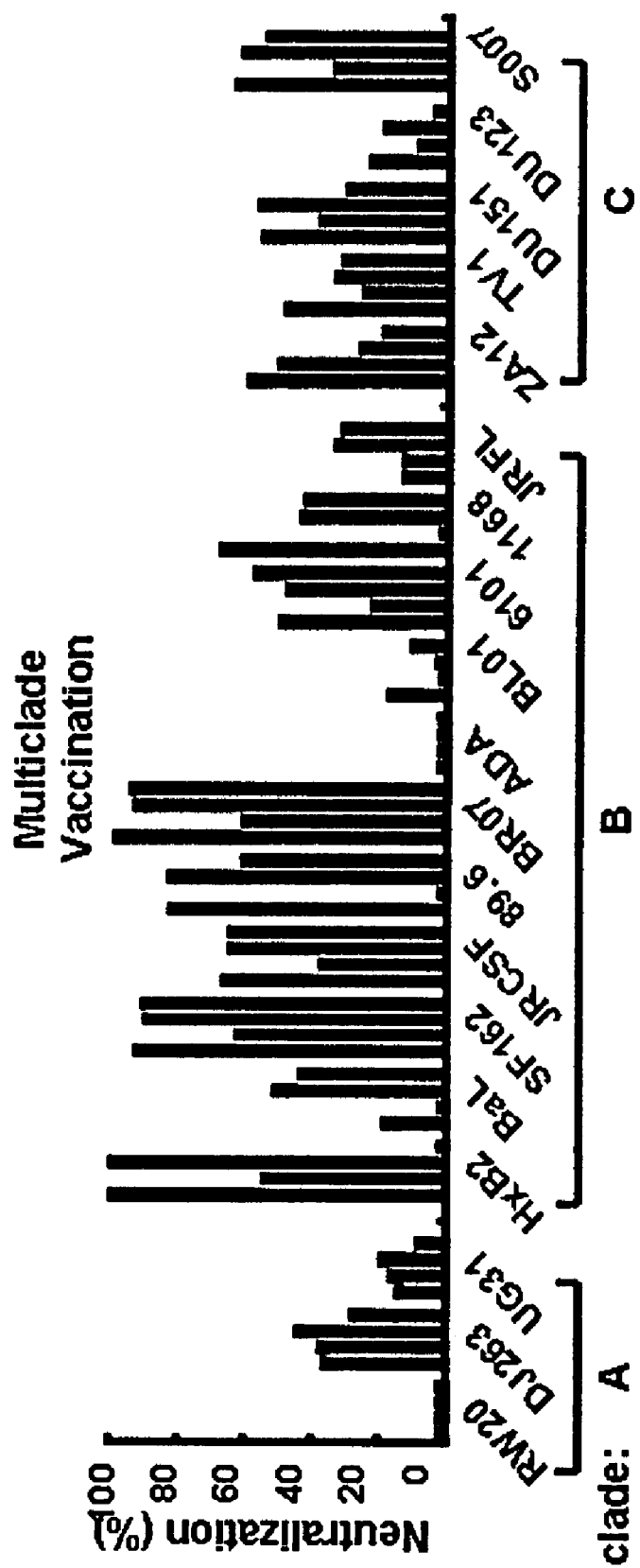

Immunization with the multiclade Env vaccine candidate increases the breadth of the neutralizing antibody response. The ability of the multiclade Env vaccine candidate to elicit neutralizing antibodies was analyzed by immunization with an equal mixture of these vectors and compared to antibodies elicited by the single clade B Env immunogen (monoclade) vaccination as described in Materials and Methods. ELISAs were done using clade-specific envelope captured on lectin-coated plates, or by using V3 peptides. Our data showed that the antibody response after HxB2/BaL immunization was directed preferentially to clade B Env and clade B V3. In contrast, sera from the multiclade immunized animals were reactive with clade A, B, and C Env proteins and V3 peptides. Antisera were tested against a panel of 19 viruses (3 clade A, 11 clade B and 5 clade C). Sera from four guinea pigs immunized with clade B gp140/145ΔCFI immunogen were able to neutralize several clade B primary isolates (FIG. 7A). This single-round of infection flow cytometric assay enumerates the number of HIV-1 infected cells and is able to detect fairly low levels of virus neutralization. In all assays, the immune sera were compared directly to the pre-immune sera from the corresponding animal. While a 1:5 serum dilution of guinea pig sera neutralized some clade B viruses, others were not neutralized at all. Additionally, very little neutralization was observed against the 3 clade A and 5 clade C viruses. Importantly, sera from guinea pigs immunized with a mixture of clade A, B, and C ΔCFI Envs maintained their neutralization of clade B viruses (FIG. 7B). Thus, the mixture of three Env plasmids did not detract from the immunogenicity of the clade B Env. Additionally, these sera displayed some modest level of neutralization against several non-clade B viruses (FIG. 7B). A non-parametric Mann Whitney test comparing the median percent neutralization value of the two groups (monoclade vs. multiclade) for each non-clade B virus was performed. The p value was less than 0.05 for virus isolates DJ263, ZA12, TV1, and DU151. Thus, for these viruses, the breadth of neutralization by the multiclade sera was significantly greater than the monoclade sera. Of note, sera from the clade B immunized guinea pigs were able to neutralize several clade B isolates with a V3 loop sequence that was divergent from the homologous BaL immunogen. Neutralization of clade B HIV BR07 and HIV 89.6 was also observed, despite the fact that these two viruses vary from HIV BaL by 10 aa and 8 aa respectively in the V3 region. Furthermore, this neutralization was V3-mediated, as it was blocked by HIV BaL V3 peptide where it remained unaffected by control peptides derived from Ebola GP (FIG. 7C).

Figure 7E:
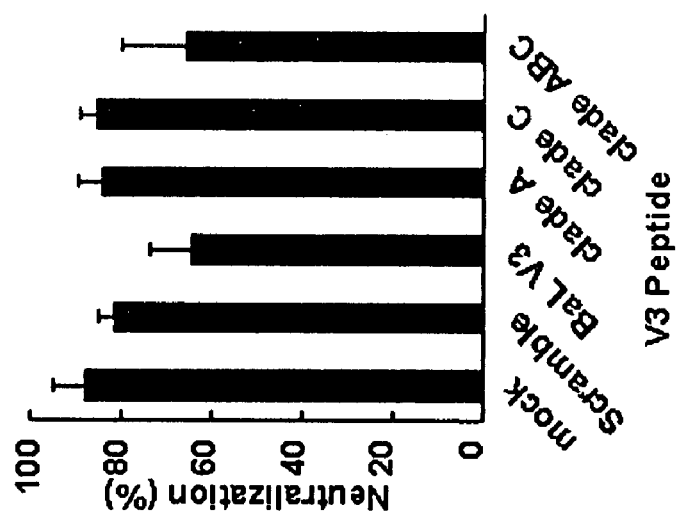
Figure 7D:
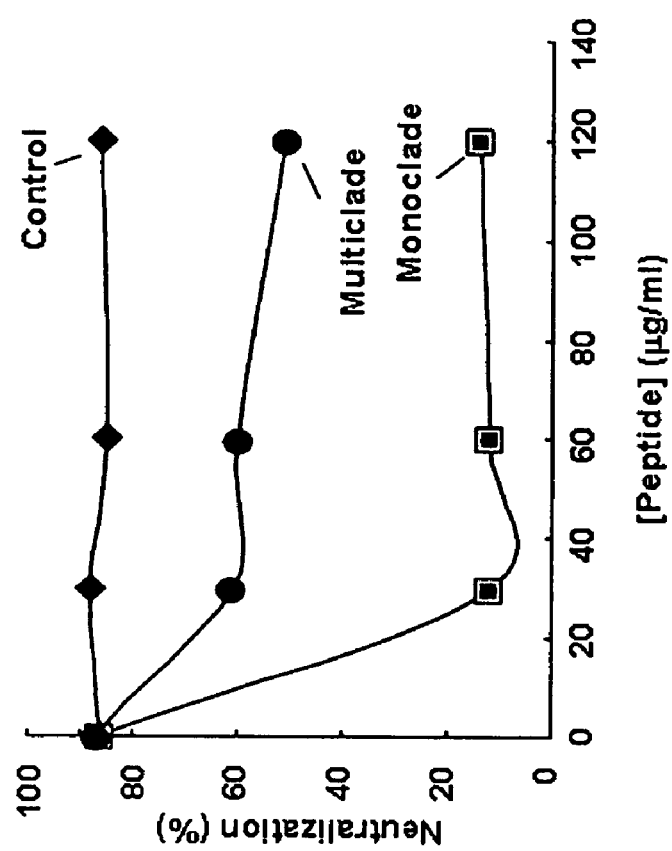

To determine the contribution of anti-V3 antibodies specificity to virus neutralization, competition studies were also performed using HIV SF162. This clade B virus was chosen because it is a fairly sensitive primary isolate that was neutralized by sera from both the clade B and multiclade immune sera. The HIV BaL V3 peptide was able to block essentially all neutralization of the clade B immune sera. Thus, anti-V3 antibodies largely mediated neutralization of HIV SF162 (FIG. 7D). While clade B-induced neutralization was abolished by HIV BaL V3 peptide, neutralization of the same isolate by sera from guinea pigs immunized with multiclade envelopes was much less sensitive to inhibition by the HIV BaL clade B V3 peptide, indicating that this neutralization was mediated by non-V3 antibodies, or by V3 antibodies that were not competed by the clade B BaL V3 peptide. To address this later possibility, we did further competition studies using clade A and C V3 peptides that matched the vaccine strains compared to no peptide or scrambled V3 peptide as controls. The addition of clade A and C peptides, or a combination of the A, B and C peptides together, produced only a small decrement in the neutralization of HIV SF162 (FIG. 7E). These data, from one guinea pig, are representative of all four guinea pigs in each group. Also, the clade A and C V3 peptides were able to block neutralization of some V3 sensitive clade A and C viruses. This result further supports the notion that the multiclade immunogen induces non-V3 dependent neutralizing antibodies. Regarding neutralization of non-clade B viruses, the modest levels of neutralization observed made V3 competition studies difficult to perform, but this is the subject of further study.

Discussion

Based on the ability of CTL to control viremia and protect against the progression of HIV disease (reviewed in Letvin, N. L. & Walker, B. D. 2003 *Nat Med* 9:861-6), an effective AIDS vaccine will need to induce a strong cell-mediated immune response. For such a vaccine to be highly effective and to induce sterilizing immunity, it will likely also be necessary to elicit broadly neutralizing antibodies. There is considerable diversity of HIV strains throughout the world, >90% of which fall into those designated as clades A, B, and C. For these reasons, gene-based vaccines encoding representative candidates from each of these clades have been analyzed in this study for their ability to induce a neutralizing antibody response. We have characterized cell-mediated immune responses and shown that these multiclade vaccines induce Env-specific CD4 and CD8 immune responses to multiple clades in mice (see PART II below). Here, we find that this multiclade vaccine permits the synthesis of native conformations of Env that induce antibodies with broader reactivity than monoclade immunogens.

For a globally effective vaccine, the cellular and humoral immunity must respond to multiple strains from these clades. The candidates developed here build on previous Env modifications that elicited more potent antibody responses while retaining their ability to stimulate Env-specific CTL (Chakrabarti, B. K. et al. 2002 *J Virol* 76:5357-68). These ΔCFI mutations were introduced into clades A and C, which retained their reactivity with known neutralizing antibodies and CD4, as well as their ability to form trimers, thus preserving physiologically relevant epitopes (FIG. 6). Importantly, all three Env constructs were immunogenic and we observed no antigenic interference compared to the monoclade immunization. Interestingly, while monoclade vaccination induced neutralizing activity that was competed by homologous HIV BAL V3 peptides, indicating that the V3 is the main epitope for eliciting neutralizing antibody, immunization with the multiclade Env elicited antisera that showed broader reactivity and was less V3-dependent. Thus, while neutralization of non clade B viruses was quite modest, this multiclade vaccine approach appeared to expand the breadth of neutralizing response. An alternative strategy, using a linear epitope of 15 amino acids that is the target of the broadly neutralizing 2F5 antibody, was less successful. This peptide sequence was inserted into the V3 region of ΔCFI Env to increase its immunogenicity. Though binding antibodies were elicited, these antibodies failed to neutralize virus, indicating that other interactions of 2F5 contribute to virus neutralization.

As the HIV-1 pandemic continues to grow, increasing numbers of recombinant strains have been reported (Kuiken, C. et al. 2000 *Human Retroviruses and AIDS* 1999. Los Alamos, N. Mex.: Los Alamos National Laboratory) and such viruses continually mutate and escape host immune responses (Barouch, D. H. et al. 2002 *Nature* 415:335-9; Mortara, L. et al. 1998 *J Virol* 72:1403-10) throughout infection. There has been considerable discussion about the choice of strains to use for candidate vaccines based on genetic relatedness to incident strains (Korber, B. et al. 2000 *Science* 288:1789-96; Robertson, D. L. et al. 2000 *Science* 288:55-6; Klausner, R. D. et al. 2003 *Science* 300:2036-9). While this selection would seem more important if only a single Env immunogen is utilized in a vaccine, it is less compelling when representatives of the major clades are included within vaccines. For the vaccine strains utilized in this study, the amino acids sequence of the clade A Env is 86% conserved relative to the ancestral and 87% to the consensus A amino acids sequences, the amino acids sequence of clade B is 88% homologous to the ancestral and 87% to the consensus B sequences, and the amino acids sequence of clade C is 88% similar to the ancestral C and 87% to consensus C (hiv.lanl.gov). These vaccine components are therefore reasonably representative of viruses from the major clade designations. Because they were derived from CCR5-tropic isolates, they were likely to retain functional epitopes relevant to viral infection, as confirmed by binding to neutralizing antibodies and CD4 (FIG. 6).

A multiclade immune response is envisioned to help to reduce the likelihood of viral escape, both from CTL and

Part II

Immunogenicity of Multiple Gene and Clade HIV-1 DNA Vaccines

Abstract

The ability to elicit an immune response to a spectrum of human immunodeficiency virus type 1 (HIV-1) gene products from divergent strains is a desirable feature of an AIDS vaccine. In this study, we have examined combinations of plasmids expressing multiple HIV-1 genes from different clades for their ability to elicit humoral and cellular immune responses in mice. Immunization with a modified Env, gp145ΔCFI in combination with a Gag-Pol-Nef fusion protein plasmid elicited similar CD4+ and CD8+ cellular responses to immunization with either vector alone. Further, when mice were immunized with a mixture of Env from three clades, A, B, and C, together with Gag-Pol-Nef, the overall potency and balance of CD4+– and CD8+– T-cell responses to all viral antigens were similar, with only minor differences noted. In addition, plasmid mixtures elicited antibody responses comparable to those from individual inoculations. These findings indicate that a multigene and multiclade vaccine, including components from A, B, C Env and Gag-Pol-Nef, can broaden antiviral immune responses without immune interference. Such combinations of immunogens are envisioned to help addressing concerns about viral genetic diversity for a prospective HIV-1 vaccine.

Introduction

The genetic variation of HIV-1 has created challenges for the development of a preventive AIDS vaccine (van der Groen, G. et al. 1998 *AIDS Res Hum Retroviruses* 14 Suppl 3:S211-S221). Not only would such a vaccine be expected to be safe and immunogenic, it must also induce immune recognition of a broad spectrum of HIV isolates to prove highly effective (Mascola, J. R. & Nabel, G. J. 2001 *Curr Opin Immunol* 13:489-495). Though progress has been made with subtype-specific and Gag- or Env-based HIV vaccines (Bojak, A. et al. 2002 *Vaccine* 20:1975-1979; Deml, L. et al. 2001 *J Virol* 75:10991-11001; Srivastava, I. K. et al. 2003 *J Virol* 77:2310-2320), an alternative approach involves the utilization of multiple viral proteins from different clades that can maximize the breadth and potency of the antiviral immune response. An unresolved question for the development of such a multivalent HIV vaccine is whether this approach can elicit strong immune responses against individual gene products without cross-interference. In previous HIV vaccine studies, some multivalent DNA vaccine approaches induced suboptimal immune responses, likely due to interference among different viral antigens (Kjerrstrom, A. et al. 2001 *Virology* 284:46-61; Muthumani, K. et al. 2002 *Vaccine* 20:1999-2003). In this study, we have addressed this question by using gene-based vaccination techniques previously used in a variety of different vaccine studies (Bonnet, M. C. et al. 2000 *Immunol Lett* 74:11-25; Moss, B. 1996 *PNAS USA* 93:11341-11348; Nabel, G. J. 2001 *Nature* 410:1002-1007; Ramsay, A. J. et al. 1997 *Immunol Cell Biol* 75:382-388).

Env is a major target of both humoral and cellular immunity, while the viral genes for Gag, Pol and Nef are potential targets of the CD8+ immune response. A modified form of HIV-1 envelope (Env), gp145ΔCFI, has been shown to improve antibody responses while maintaining its ability to induce cytotoxic T-lymphocyte (CTL) responses (Chakrabarti, B. K. et al. 2002 *J Virol* 76:5357-5368). A fusion protein of Gag and Pol has also been developed that generates a protein from a single open reading frame that can be processed to present linear epitopes from at least four viral gene products: Gag, protease (PR), reverse transcriptase (RT), and integrase (IN) (Huang, Y. et al. 2001 *J Virol* 75:4947-4951). To ensure that the pol region did not function in vivo, three point mutations were introduced, in PR, RT and IN, termed Pol(ΔPR ΔRT ΔIN). An additional viral protein, Nef, was included to expand its breadth, and representatives of Clades A, B and C were also generated.

The present study evaluates the immunogenicity of Env and Gag-Pol-Nef vaccine candidates alone or in combination. In addition, the ability to combine these immunogens from different clade isolates has also been evaluated. The combination of Gag-Pol-Nef with Env elicited strong CD8 immunity to Env without compromising the CD4 or antibody response. In addition, combinations of Env from multiple clades help to expand the immune response to these alternative clades. The combination of multiple HIV genes from different clades is envisioned to facilitate the generation of immune responses to diverse HIV strains.

Materials and Methods

Gag-Pol-Nef Immunogens. Plasmids expressing HIV genes were synthesized by reverse translation (Genetics Computer Group, Inc., Madison, Wis.) of published sequences using codons expected for human cells. The methods used to make DNA plasmids expressing HIV-1 Gag-Pol-Nef polyproteins from different clades were similar to those previously described for Gag-Pol (Huang, Y. et al. 2001 *J Virol* 75:4947-4951). To further inactivate viral proteins, additional inactivating mutations were inserted into protease (PR), reverse transcriptase (RT), and integrase (IN). The amino acid sequence of the Nef protein was not modified, but the NH$_2$-terminal myristylation site required for its functional activity was not available, as it is synthesized as a fusion protein. The clade A, B and C Gag-Pol-Nef plasmids were 9783, 9790 and 9786 nucleotides in length, respectively, and the clade A, B, and C Env plasmids are 6836, 6869 and 6829 nucleotides.

These genes were synthesized by preparation of oligonucleotides of 75 base pairs overlapping by 25, or 60 base pairs overlapping by 20, and assembled by Pwo (Boehringer Mannheim) and Turbo Pfu (Stratagene) as described previously (Chakrabarti, B. K. et al. 2002 *J Virol* 76:5357-5368; Huang, Y. et al. 2001 *J Virol* 75:4947-4951). The cDNAs were cloned into the expression vector pVR1012 (Chakrabarti, B. K. et al. 2002 *J Virol* 76:5357-5368; Yang Z et al. 1998 *Science* 279:1034-1037). The protein sequence of each Gag polyprotein from the appropriate HIV-1 clade was used to create a synthetic version of the gag gene (gag/h) using codons preferred for expression in human cells. The synthetic gag/h gene contained all mature Gag proteins except for p1 and p6 (amino acids 433-500). The synthetic gag/h gene from clade A, B, or C was ligated in frame with codon-modified pol (pol/h) encoding amino acids 3-1003 from NL4-3 (GenBank accession number M19921). To inactivate the fusion proteins further, a protease (PR) mutation (Arg to Gly) was inserted at aa 553, a reverse transcriptase (RT) mutation (Asp to His) at aa 771, and an integrase (IN) mutation (Asp to Ala) at aa 1209. A synthetic nef gene (nef/h) based on aa 1 to 206 from NL4-3 was fused to the 3' end of pol/h by PCR to generate the appropriate Gag-Pol-Nef expression vector.

For the clade A Gag-Pol-Nef fusion protein, amino acids 1 to 432 from a CCR5-tropic clade A (GenBank accession number AF004885) were used and fused to the pol/h gene described above. In all three Gag-Pol-Nef plasmids, the same pol sequence was inserted, as this viral gene product is more than 90% conserved at the amino acid level among disparate clades. To add a matched Nef open reading frame, the stop codon in pol was removed, and synthetic clade A nef/h (GenBank accession number: AF069670) was fused to the 3' end of pol/h by PCR to generate the clade A plasmid, pVRC-4313. For the clade B Gag-Pol-Nef fusion protein, sequence encoding amino acids 1 to 432 from a CCR5-tropic clade B (GenBank accession number K03455) was used and fused to the pol/h described above. To add a clade B Nef protein, the stop codon from Pol was removed and fused to a clade B synthetic Nef/h gene (aa 1 to 206) from HIV-1 PV22 (GenBank accession number K02083) to generate the clade B plasmid, pVRC-4306. For the clade C Gag-Pol-Nef fusion protein, amino acids 1 to 432 from a CCR5-tropic clade C (GenBank accession number U52953) were used and fused to the pol/h gene described above. The Pol stop codon was removed and fused to synthetic clade C Nef/h (aa 1 to 206) (GenBank accession number: U52953), designated pVRC-4311.

Alternative Clade Env Plasmid DNAs. The sequences used to create the DNA plasmids encoding Env are derived from three HIV-1 CCR5-tropic strains of virus that have been modified to reduce potential cellular toxicity and increase immunogenicity by deletion of the fusion domain, the cleavage domains, and also by shortening of the interspace between heptad 1 (H1) and heptad 2 (H2), as described previously for clade B isolates (Huang, Y. et al. 2001 *J Virol* 75:4947-4951). The synthetic protein sequence for the clade A Env polyprotein (gp160) was derived from 92rw020 (R5-tropic, GenBank accession number U51283) and designated clade A gp145ΔCFI/h. An XbaI site was inserted 18 nucleotides upstream from the ATG, together with a known Kozak sequence, and a BamH1 site created 1,912 nt downstream of the ATG for all Env expression vectors. This fragment was cloned into the XbaI-to-BamH1 sites of pVR1012x/s sites. The fusion and cleavage domains from amino acids 486-519 and the interspace between H1 and H2 from amino acids 576-604 were deleted. The protein sequence of the clade B Env glycoprotein (gp160) from HXB2 (X4-tropic, GenBank accession number K03455) was used to create a synthetic version of the gene (X4gp160/h) by alteration of codons for better expression in human cells. The nucleotide sequence X4gp160/h shows little homology to the HXB2 gene, but the protein encoded is the same with the following aa substitutions: aa 53 (Phe→Leu), aa 94 (Asn→Asp), aa 192 (Lys→Ser), aa 215 (Ile→Asn), aa 224 (Ala→Thr), aa 346 (Ala→Asp), and aa 470 (Pro→Leu). To produce an R5-tropic version of the envelope glycoprotein (R5gp160/h), the region encoding HIV-1 envelope glycoprotein amino acids 205 to 361 from X4gp160/h was replaced with the corresponding region from the BaL strain of HIV-1 (GenBank accession number M68893, again using human-preferred codons). The full-length CCR5-tropic version of the envelope gene from pR5gp160/h was terminated after the codon for aa 704 to generate gp145/h. The fusion and cleavage domains from amino acids 503-536 and the interspace between H1 and H2 from amino acids 593-620 were then deleted. The protein sequence of the clade C Env polyprotein (gp145ΔCFI) from 97ZA012 (R5-tropic, GenBank accession number AF286227) was used to create a synthetic version of the gene (clade C gp145ΔCFI/h) with deletion of the fusion and cleavage domains from amino acids 487-520 and the interspace between H1 and H2 from amino acids 577-605.

Immunizations. Mice received two 100-μl injections intramuscularly in each thigh at days 0, 14 and 42. Ten days after the final injection, mice were bled and sera were collected. Then the mice were sacrificed, spleens were removed, and the spleen cells were analyzed by intracellular cytokine flow cytometry (ICC) for CD4+ and CD8+ T-cell responses.

Flow Cytometric Analysis of Intracellular Cytokines. CD4+– and CD8+– T-cell responses were evaluated by using intracellular cytokine flow cytometry (ICC) for gamma interferon (IFN-γ) and tumor necrosis factor-alpha (TNF-α). This sensitive assay was developed to study the immune responses to HIV-1 (Dorrell, L. et al. 2001 *Eur J Immunol* 31:1747-1756; Goepfert, P. A. et al. 2000 *J Virol* 74:10249-10255; Maecker, H. T. et al. 2001 *J Immunol Methods* 255:27-40; Migueles, S. A. & Connors, M. 2001 *Immunol Lett* 79:141-150; Novitsky, V. et al. 2001 *J Virol* 75:9210-9228). The assay was performed by removal of spleens, gentle homogenization to single-cell suspension, erythrocyte lysis with PharMLyse (BD-Pharmingen), washing with medium, and stimulation ($10^7$ cells/ml) at 37° C. for 1 h with peptide pools (2.5 μg/ml for each peptide). All peptides used in this study were 15-mers overlapping by 11 amino acids that spanned the complete sequence of the HIV or negative control proteins tested. Anti-CD28 and anti-CD49d antibodies (BD-Pharmingen 553294 and 553153 respectively) were added (1 μg/ml) to the medium for costimulation. After an hour, brefeldin A (Sigma) was added to the medium (10 μg/ml) for an additional 5 h. After a total of 6 h, cells were washed and incubated with FC block (BD-Pharmingen) for 15 min on ice, fixed, and permeabilized with Cytofix/Cytoperm (BD-Pharmingen) according to manufacturer's instructions. The cells were washed with phosphate-buffered saline (PBS) with 0.1% saponin (Sigma) followed by staining with the indicated fluorescent-labeled monoclonal antibodies against CD3, CD4, CD8, IFN-γ and TNF-α (BD-Pharmingen) for 20 min on ice. After washing with PBS with 0.1% saponin, the cells were analyzed by fluorescence-activated cell sorting (FACS) to detect the IFN-γ- and TNF-α-positive cells in the CD4+ and CD8+ cell populations and analyzed with the program FlowJo (Tree Star, Inc.).

ELISA Assays. To detect antibodies against Env proteins of different clades, enzyme-linked immunosorbent assay (ELISA) plates were coated with 100 μl of Galanthus Nivalis lectin (10 μg/ml) overnight at 4° C. The lectin solution was removed from the wells and blocked with 200 μl of PBS containing 10% fetal bovine serum (FBS) for 2 h at room temperature. The plates were washed twice with PBS containing 0.2% TWEEN™ 20 (PBS-T) and then 100 μl of supernatant from cells transfected with pVRC5304 (R5 gp140ΔCFI-Clade-A), pVRC2801 (R5 gp140ΔCFI-Clade-B), or pVRC5308 (R5 gp140ΔCFI-Clade-C) was added to each well, and wells were incubated for an hour at room temperature. The plates were washed with PBS-T five times, and then the sera from immunized mice from different groups were added with 3-fold dilutions for 1 h. The plates were washed with PBS-T five times, and then 100 μl of 1:5,000-diluted secondary antibody-conjugated horseradish peroxidase (HRP) was added, and mixtures were incubated for 1 h, and washed with PBS-T five times. Then 100 μl of substrate (Sigma Fast o-phenylenediamine dihydrochloride, catalog #P-9187) was added in each well for 30 min. The reaction was then stopped by adding 100 μl of 1 NH2SO4 and the optical density (OD) reading was taken at 450 nm.

Statistical Analysis. For the simpler combination of plasmids listed in Table 1, Kruskal-Wallis tests were performed to test for overall differences in the three treatment groups' CD4+ and CD8+ response rates within each gene and clade combination at an α of 0.05. Within each of the two sets of tests (CD4+ and CD8+ responses), the Holm procedure was used to adjust the P values for multiple comparisons for each gene and clade combination. If the adjusted P value from the Kruskal-Wallis test for a given response-gene-clade combination was less than an α of 0.05, two-sided Wilcoxon tests were performed for all three possible pairs of different combinations (control vs. ABC(x4), control vs. ABC(x6), ABC (x4) vs. ABC(x6)). Again, the Holm procedure was used to adjust the P values for multiple comparisons. An adjusted P value less than an a of 0.05 was taken as evidence of a significant difference. An analogous approach was taken to test for differences among the groups immunized with Env and Gag-Pol-Nef plasmids (FIG. 8).

Results

Figures 1, 8A:
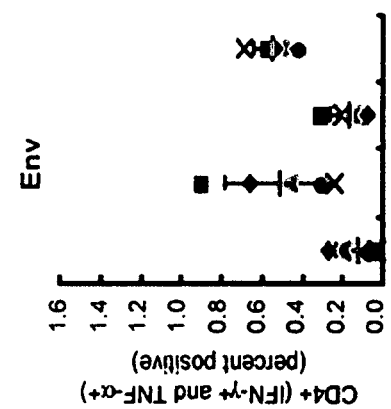
Figures 2, 8A:
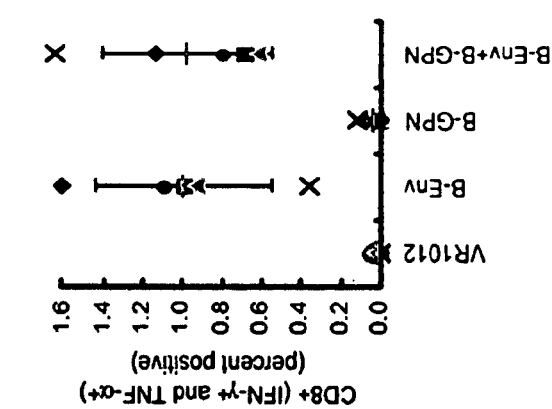
Figures 3, 8A:
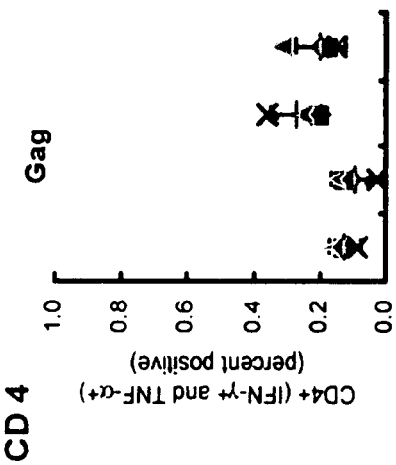
Figures 4, 8A:
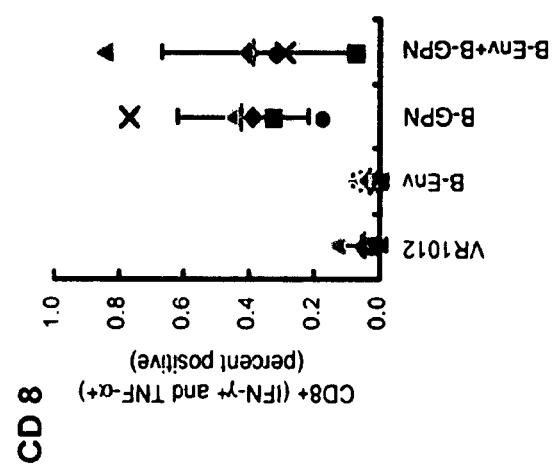
Figure 8B:
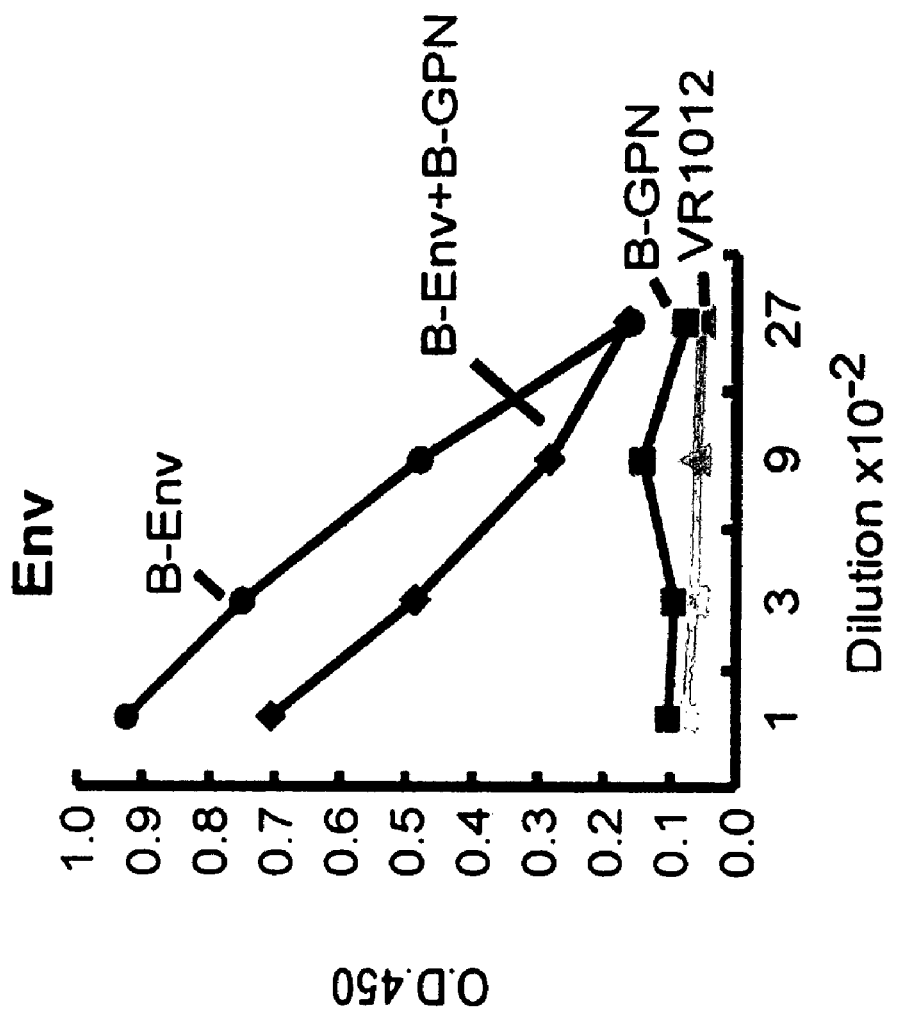

A combination of Env and Gag-Pol-Nef plasmids elicited $CD4^+$ and $CD8^+$ responses to Env and Gag similar to those obtained with single plasmids alone. To examine whether combined immunization with Env and Gag-Pol-Nef plasmids would enhance or inhibit antigen-specific responses, the CD4, CD8, and antibody responses to Env were analyzed. Four groups of mice with 5 mice per group were immunized with the control vector alone, Env with control vector as filler DNA, Gag-Pol-Nef with control vector as filler DNA, or Env with Gag-Pol-Nef. Ten days after the final DNA immunization, animals were sacrificed, and splenocytes were incubated with overlapping Gag peptide pools. Intracellular IFN-γ and TNF-α expression in stimulated CD4+ or CD8+ lymphocytes were analyzed by flow cytometry, and positive cells were enumerated. Cells from mice immunized with Gag-Pol-Nef alone and those immunized with the combination of Env and Gag-Pol-Nef responded similarly to Gag stimulation (FIG. 8A, left). Likewise, lymphocytes from mice vaccinated with Env alone, and those with a combination of Env and Gag-Pol-Nef, responded similarly to incubation with Env peptide pools (FIG. 8A, right). Based on statistical analysis, there was no difference in CD4 response to Gag between the Gag-Pol-Nef group and the combined Env and Gag-Pol-Nef group (P=0.1746). Also, there was no difference in the CD4 response to Env between the Env group and the combined Env and Gag-Pol-Nef group (P=0.6905). In the case of CD8 responses to Gag, there was also no statistical difference between Gag and the combined Env and Gag-Pol-Nef group (P=1.0), and in the case of the CD8 responses to Env, there was also no statistical difference between Env and the combined Env and Gag-Pol-Nef group (P=1.0). Similarly, antibody to Env showed similar titers in both groups (FIG. 8B). There was no statistical difference between Env and the combined Env and Gag-Pol-Nef group (P>0.05) in antibody response to Env at all four dilutions. This result indicated that combination plasmid vaccination did not cause immune interference but instead led to expanded breadth of the immune response. To determine whether the addition of alternative clades would prove similarly immunogenic, more complex plasmid combinations were evaluated.

Figures 1, 2, 9A:
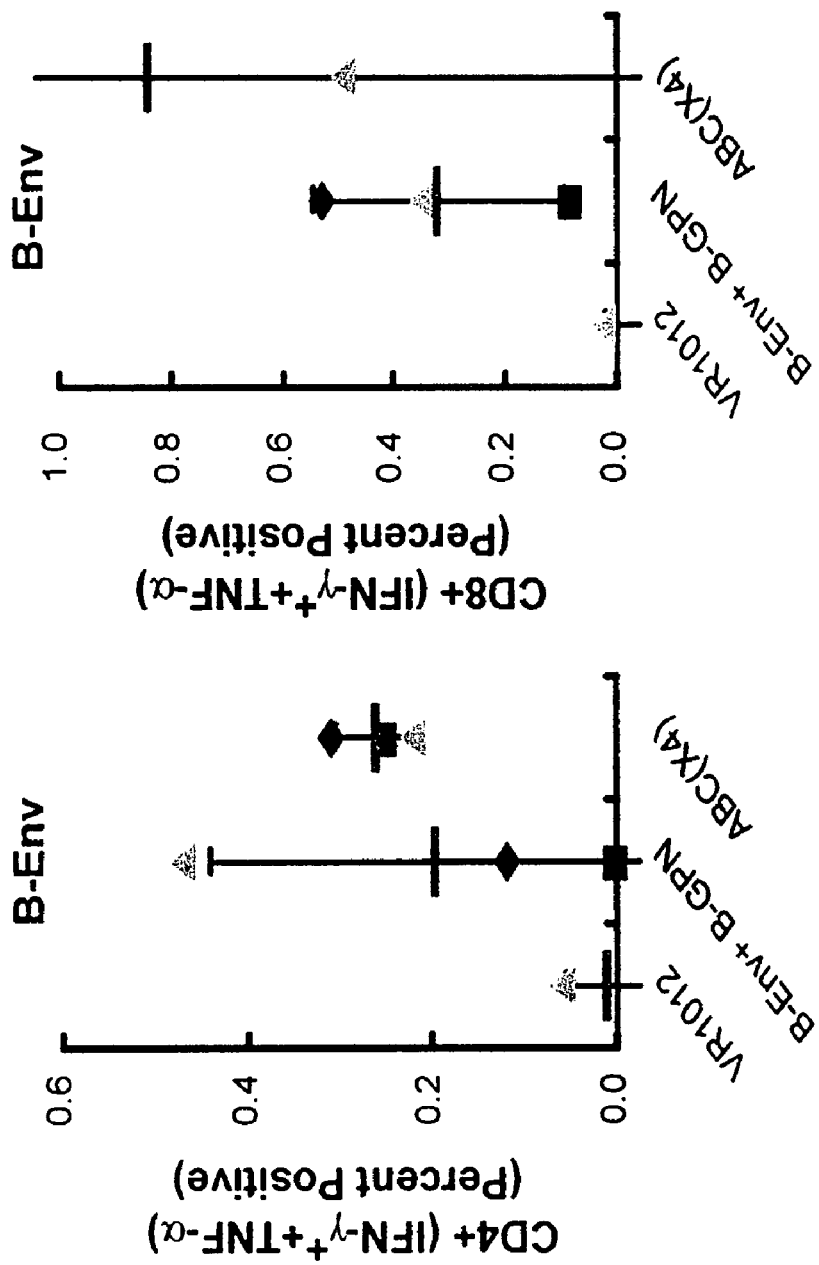

Combination of Env clades and Gag-Pol-Nef vaccination elicits similar immune responses to single clade immunogens. We next determined whether the inclusion of multiple Env immunogens would affect the breadth and potency of the immune response. Mice were immunized with a negative control plasmid, combined Env and Gag-Pol-Nef (both from clade B), or Env from clades A, B and C with Gag-Pol-Nef from clade B, termed ABC(x4). In the ABC(x4) group, the three Env proteins were retained in equal proportions, and the ratio of all Env proteins to all Gag-Pol-Nef proteins was kept constant (1:1, wt/wt). Both the combined Env and Gag-Pol-Nef group and the ABC(x4) group induced CD4+ and CD8+ responses similar to those obtained with clade B Env (FIG. 9A). Some minor variations in immune responses were seen between groups; however, both the clade B and the ABC(x4) groups showed comparable CD4+ and CD8+ responses to clade B Env peptide stimulation by intracellular flow analysis. For antibody responses, ABC(x4) showed a measurable response to clade A Env stimulation but as expected, not in the clade B-immunized group, which did not contain Clade A Env. More importantly, immunization with the clade B immunogens gave rise to titer responses to clade B Env similar to those obtained with ABC(x4), again showing that the mixture of multiple clades did not inhibit the responses to a single-clade (B) Env component, despite the relative dilution of the immunogen. Neither the ABC(x4) nor the clade C Env alone induced a high-titer antibody response, possibly because of the lack of highly reactive epitopes in mice (FIG. 9B). These results indicated that the addition of multiple Env proteins from alternative clades to Gag-Pol-Nef did not interfere with T-cell or humoral immunity and instead added breadth to the immune response.

Comparison of different combination multiple clade immunogens. We next compared different combinations of plasmids that could elicit immune responses to multiple immunogens. Mice were immunized with the control plasmid and two combinations of plasmids (Table 1), including a combination of six plasmids, designated ABC(x6), because it covered the Gag, Nef, and Env from Clades A, B and C with Pol from Clade B, or the ABC group with four components, ABC(x4), in which the Gag-Pol-Nef fusion protein from Clade B was used alone, rather than with the Gag-Pol-Nef proteins from Clades A and C. As above, the three Env clades were retained in similar ratios and amounts in both formulations, and the ratio of all Env proteins to all Gag-Pol-Nef proteins was kept constant (1:1, wt/wt).

TABLE 1

Experiment schema for analysis of plasmid combinations in mice. Design of study to test different combinations of plasmids, with 10 mice per group.

| Vaccine | Plasmid | Amount |
|---|---|---|
| VR1012 | 1012 | 50 μg |
| ABCx4 | 1012-A-gp145ΔCFI | 8.3 μg |
|  | 1012-B-gp145ΔCFI | 8.3 μg |
|  | 1012-C-gp145ΔCFI | 8.3 μg |
|  | 1012-B-gag-pol-nef | 25 μg |
| ABCx6 | 1012-A-gp145ΔCFI | 8.3 μg |
|  | 1012-B-gp145ΔCFI | 8.3 μg |
|  | 1012-C-gp145ΔCFI | 8.3 μg |
|  | 1012-A-gag-pol-nef | 8.3 μg |
|  | 1012-B-gag-pol-nef | 8.3 μg |
|  | 1012-C-gag-pol-nef | 8.3 μg |

Both plasmid combination groups had similar CD8 response to Gag, Pol, and Env from Clade B, but not from other clades (FIG. 10) and Table 2. Responses to Gag from Clades A and B were significantly higher than the control (pVR1012) for both ABC(x6) and ABC(x4), but the differences between the response rates of the two treatment groups were not significantly different for either of these clades. CD8+ responses to Pol-1 and Env from Clade B were significantly higher than the control (pVR1012) responses for both ABC(x6) and ABC(x4). However, CD8+ responses to Env from Clade A were higher than the control for ABC(x6) only (P=0.0316) (FIG. 10C) and Table 2.

TABLE 2

Summary of the T cell and antibody responses to different vaccine candidates.

| Analysis | Vaccine | Response to: | | | | | | | | | | |
|---|---|---|---|---|---|---|---|---|---|---|---|---|
| | | A-gag | B-gag | C-gag | A-env | B-env | C-env | B-pol- | B-pol- | A-nef | B-nef | C-nef |
| ICC[a] | ABC(x4) | + | + | − | + | + | + | + | + | − | + | − |
| CD4 | ABC(x6) | + | + | + | + | + | ++ | − | + | − | − | − |
| ICC | ABC(x4) | + | + | − | − | + | − | + | − | − | − | − |
| CD8 | ABC(x6) | + | + | + | + | + | − | + | − | − | − | − |
| ELISA[b] | ABC(x4) | | | | + | + | + | | | | | |
| | ABC(x6) | | | | + | + | + | | | | | |

[a]CD4+- and CD8+-T-cell responses to different vaccine candidates. When Holm-adjusted Kruskal-Wallis tests indicated overall significant differences, the data from all possible pairs of groups were compared by Wilcoxon tests with a Holm adjustment for the multiple comparisons. −, no statistically significant difference from the control (P > 0.05); +, statistically significant difference from the control only (P < 0.05); ++, statistically significant difference from both the control and all other treatment groups (P = 0.05).
[b]Antibody responses to different vaccine candidates. +, the average antibody titer of the group was more than 1:1,000

ABC(x6) and ABC(x4) induced similar CD4+ responses, in contrast to the control (pVR1012) plasmids in mice. Both stimulated higher CD4+ responses for Gag from Clade A and B, Pol-2 from Clade B, and Env from Clades A and B (Table 2). ABC(x6) elicited significantly higher CD4+ responses to clade C Gag (P=0.0138) than the control (pVR1012), while for Nef and Pol-1 from Clade B, only ABC(x4) provoked significantly higher CD4+ responses than the control (P=0.0097 for Nef, P=0.0054 for Pol-1). CD4+ responses to Env from Clade C were higher for ABC(x6) compared to ABC(x4) (P=0.0418), although the responses for both groups were significantly higher than the control (pVR1012) (FIG. 11 and Table 2). ABC(x4), but not ABC(x6), showed a response to Nef from Clade B (Table 2). In summary, except for relatively minor differences in specificity, both ABC(x6) and ABC(x4) elicited comparable cell-mediated immune responses.

Figures 1, 2, 3, 11B:
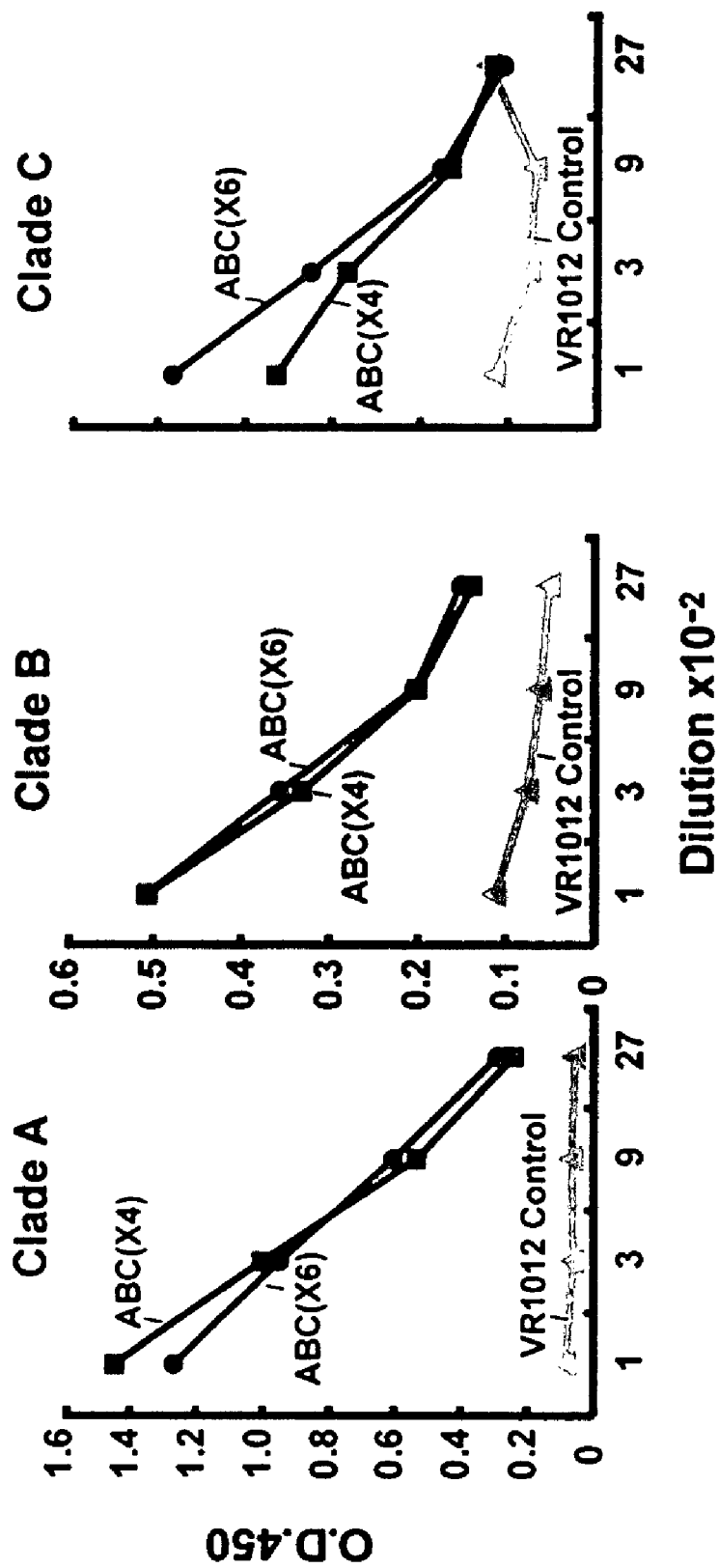

Similar antibody responses in ABC(x4), ABC(x6) and single clade vaccinated mice to Envs from all clades. Sera from ABC(x4), ABC(x6), or single-clade groups were tested for antibody responses using a lectin-capture HIV-1 Env protein ELISA system. The sera from the two test groups showed similar responses to Env protein to all three clades (FIG. 11B). Antibody titers against Clade A Env protein from both ABC(x4) and ABC(x6) groups were higher than the antibody titers against Clade B and Clade C Env protein; however, there was no significant difference between the two groups in terms of their antibody response magnitude. This result indicated that addition of Gag and Nef immunogens from Clade A and Clade C to ABC(x4) groups did not interfere with the antibody responses against Env from Clade B.

Discussion

One requirement of a highly effective AIDS vaccine is the need to induce both neutralizing antibodies and cellular immunity to the many strains of HIV-1 that circulate throughout the world. In this study, we have evaluated the ability of plasmid DNA vaccines to elicit immune responses to multiple gene products of HIV-1 from alternative clades of virus. The goal was to elicit both antibody and T cell responses against various HIV genes from these different clades. Env, Gag, Pol and Nef were chosen as targets because they represent the major expressed proteins during viral infection. A mutant Env with deletions in the cleavage site, fusion domain, and a region between the heptad repeats was used for its ability to elicit a more potent humoral immune response while retaining its ability to stimulate Env-specific cytotoxic T lymphocytes (CTL) (Chakrabarti, B. K. et al. 2002 J Virol 76:5357-5368).

A variety of previous studies have shown that CTL contribute to the control of viremia and protect against the progression of HIV disease (Borrow, P. et al. 1994 J Virol 68:6103-6110; Jin, X. et al. 1999 J Exp Med 189:991-998; Klein, M. R. et al. 1995 J Exp Med 181:1365-1372; Koup, R. A. et al. 1994 J Virol 68:4650-4655; Moss, P. A. H et al. 1995 PNAS USA 92:5773-5777; Musey, L. et al. 1997 N Engl J Med 337:1267-1274; Ogg, G. S. et al. 1998 Science 279:2103-2106; Rowland-Jones, S. L. et al. 1998 J Clin Invest 102: 1758-1765; Rowland-Jones, S. L. et al. 1993 Lancet 341:860-861; Rowland-Jones, S. L. et al. 1995 Nat Med 1:59-64; Schmitz, J. E. et al. 1999 Science 283:857-860). Processed forms of Gag, Pol, Nef and Env presented on class I MHC antigens can serve as the targets of CTL that recognize and lyse HIV-1 infected cells, in this way contributing to the efficacy of a preventive vaccine. If the T cell response is sufficiently robust, it is hoped that these cells will kill HIV-infected cells before the virus can replicate and establish a reservoir of infection in vivo. For a globally effective vaccine, it will be necessary to elicit CTL that react with strains from multiple clades. Though there may be some cross-clade reactivity after immunization with a single clade (e.g., Keating, S. M. et al. 2002 AIDS Res Hum Retroviruses 18:1067-1079), there is also evidence of disparities in such immune responses, (e.g., Dorrell, L. et al. 2001 Eur J Immunol 31:1747-1756). It therefore is desirable to include representatives of the major classes of virus in a DNA vaccine to induce cross-clade immunity. However, the main concern of such a cocktail is whether it will cause interference between gene-specific immune responses. Interference among immune responses to various viral genes has been seen previously in murine HIV immunization studies (Kjerrstrom, A. et al. 2001 Virology 284:46-61; Muthumani, K. et al. 2002 Vaccine 20:1999-2003). Recently, studies of modifications to HIV DNA vaccines, including different combinations of viral genes, altered RNA structure/codon usage, and/or stimulatory cytokine genes, have shown more encouraging results in mice (zur Megede, J. et al. 2003 J Virol 77:6197-6207). More importantly, some approaches have shown promise in challenge studies using non-human primates (Amara, R. R. et al. 2001 Science 292:69-74; Barouch, D. H. et al. 2000 Science 290:486-492; Kim, J. J. et al. 2001 Virology 285:204-217;

Letvin, N. L. 2002 *J Clin Invest* 110:15-20; McKay, P. F. et al. 2002 *J Immunol* 168:332-337; Shiver, J. W et al. 2002 *Nature* 415:331-335), though complete protection against infection has been difficult to achieve. Additional modifications were therefore incorporated in this study in an attempt to improve efficacy.

When the immune responses to different combinations of Env and Gag-Pol-Nef were compared, there was no decrease in the humoral and cellular response to Clade B mutant Env plasmid and Gag-Pol-Nef plasmids when mixed compared with the two plasmids individually (FIG. 8). When the complexity was increased to four components, including gp145ΔCFI from three clades and Gag-Pol-Nef from Clade B, there was no interference with the humoral response to B-env at the same time that the immune response to other clades was enhanced.

When the complexity of the vaccine was increased to six components, ABC(x6), containing the same Env-gp145ΔCFI from different clades as in group ABC(x4) plus the Gag-Pol-Nef fusion protein from clades A and C, minor differences in immunogenicity were seen. Analyzing the Gag response, ABC(x4) elicited CD4$^+$ and CD8$^+$ responses to clades A and B, while ABC(x6) improved the response to clade C Gag peptides. The lack of CD4$^+$ and CD8$^+$ responses to Clade C Gag in ABC(x4) probably is due to the absence of clades A and C Gag; however, ABC(x4) containing only clade B Gag could induce both CD4$^+$ and CD8$^+$ responses to clade A Gag even though it shares only 85% homology in amino acid sequence. This result indicated that clades A and B Gag share some common CD4$^+$ and CD8$^+$ epitopes but differ more substantially from clade C Gag in mice. In contrast, the CD4$^+$ and CD8$^+$ responses against Env between ABC(x4) and ABC (x6) were similar: both groups elicited comparable CD4$^+$ responses against all three clades and generated similar CD8$^+$ responses against clade B Env. ABC(x6) also induced a significant CD8$^+$ response to Env from Clade A.

Figures 10B-1, 10B-2:
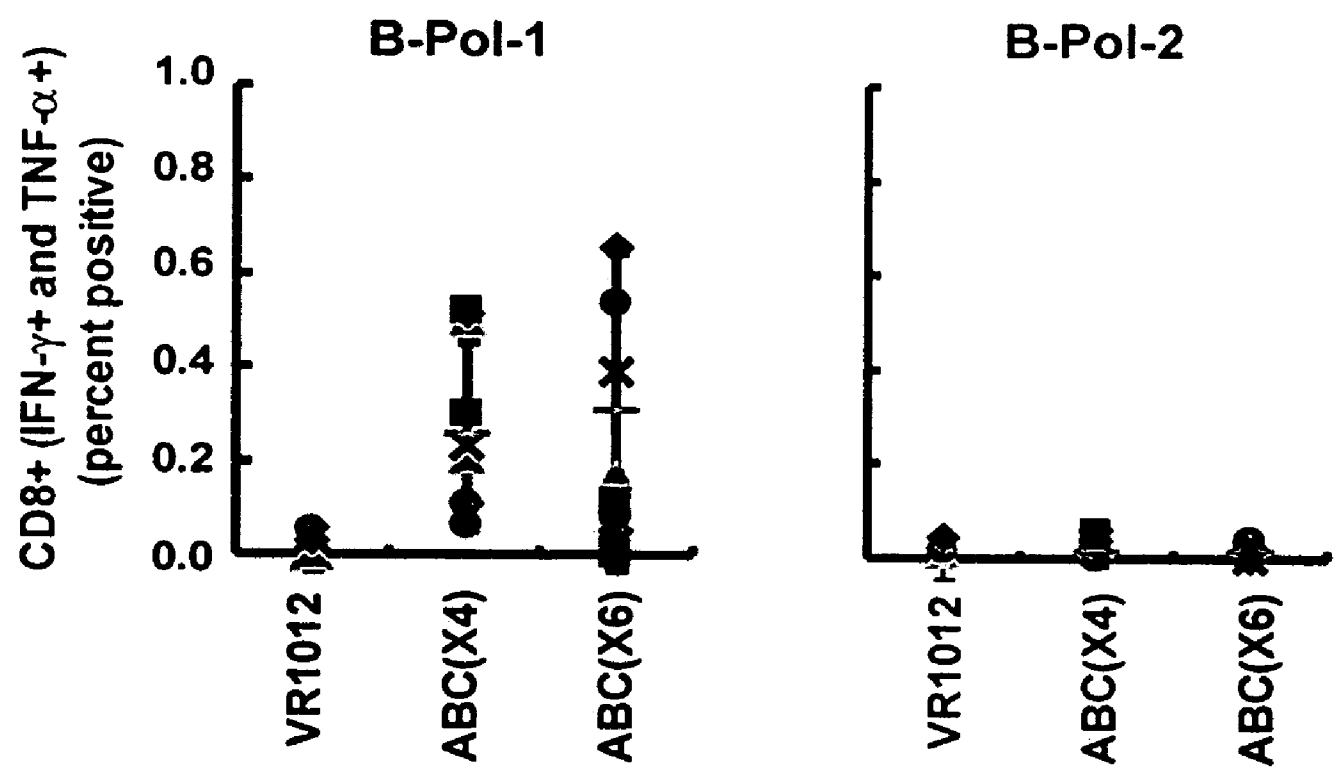

For Pol responses, both groups demonstrated CD4$^+$ and CD8$^+$ responses against Pol from Clade B. The ABC(x4) group elicited a CD4$^+$ response to both sets of Pol peptides, while ABC(x6) stimulated CD4$^+$ response only against one of the two Pol peptide pools (Table 2). Both groups induced CD8+ responses to the first half of the Clade B pol (FIG. 10B, left panel). For Nef, only the ABC(x4) group elicited a CD4+ response against Nef from clade B (Table 2). The poor anti-Nef response also may be due to the inability of Balb/c mice to recognize Nef epitopes, as other groups have reported that Nef is highly immunogenic in other strains of mice (Kjerrstrom, A. et al. 2001 *Virology* 284:46-61).

In addition, we attempted to determine whether CD4$^+$ and CD8$^+$ T cell responses against multigenes would affect humoral responses. There was no significant difference among different groups in ELISA titers (summarized in Table 2). All the groups showed similar antibody titers to Env protein from Clades A, B and C (FIG. 11B). These data indicated that there was no interference among different clades of Env in antibody response. Equally importantly, there was no interference among various viral genes between humoral and cellular responses.

In summary, the ABC(x4) vaccine regimen was able to induce substantial and balanced CD4$^+$ and CD8$^+$ T cell responses to the viral antigens from different clades. The results here indicate that a multi-gene HIV-1 DNA vaccine is feasible because the immune responses to individual genes do not cause interference when combined with one another. As the HIV-1 pandemic continues to grow, the concern about virus variability becomes increasingly problematic. Though a few subtypes of HIV-1 predominate in different regions of the world, a rising number of recombinant strains have been reported lately (Kuiken, C. et al. 2000. *Human Retroviruses and AIDS* 1999. Los Alamos National Laboratory, Los Alamos, N. Mex.). Such viruses continually mutate and escape (Barouch, D. H. et al. 2002 *Nature* 415:335-339; Mortara, L. et al. 1998 *J Virol* 72:1403-1410) during different stages of infection. A multiepitope and multiclade immune response should help to reduce the likelihood of viral escape. The data presented in this study therefore guides the development of improved vaccines against diverse strains of HIV.

Part III

Selective Modification of Variable Loops Alters Tropism and Enhances Immunogenicity of HIV-1 Envelope Abstract Although the B clade of HIV-1 envelope (Env) includes five highly variable regions, each of these domains contains a subset of sequences that remain conserved. The V3 loop has been much studied for its ability to elicit neutralizing antibodies, which are often restricted to a limited number of closely related strains, likely because a large number of antigenic structures are generated from the diverse amino acid sequences in this region. Despite these strain-specific determinants, subregions of V3 are highly conserved, and the effect of different portions of the V3 loop on Env tropism and immunogenicity has not been well delineated. In this study, selective deletions in V3 have been introduced by shortening the stem of the V3 loop. These mutations were explored in combination with deletions of selected V regions. Progressive shortening of the stem of V3 abolished the immunogenicity as well as the functional activity of HIV Env; however, two small deletions on both arms of the V3 stem altered the tropism of the dual-tropic 89.6P viral strain so that it infected only CXCR4$^+$ cells. When this smaller deletion was combined with removal of the V1 and V2 loops and used as an immunogen in guinea pigs, the antisera were able to neutralize multiple independent clade B isolates with higher potency. These findings indicate that highly conserved subregions within V3 are relevant targets to elicit neutralizing antibody responses, affecting HIV tropism, and increasing the immunogenicity of AIDS vaccines.

Introduction

Among the mechanisms used by HIV to avoid immune recognition and antibody neutralization, the variable regions of the envelope play an important role in evasion. The envelope protein utilizes a variety of mechanisms to evade detection, including carbohydrate modification, conformational flexibility, and genetic variability between isolates (Burns, D. P. & Desrosiers, R. C. 1994 *Curr Top Microbiol Immunol* 188:185-219; Burton, D. R. 2002 *Nat Rev Immunol* 2:706-713; Chakrabarti, B. K. et al. 2002 *J Virol* 76:5357-5368; Gorny, M. K. et al. 2002 *J Virol* 76:9035-9045; Kwong, P. D. et al. 2002 *Nature* 420:678-682; Wei, X. et al. 2003 *Nature* 422:307-312). Genetic diversity in specific segments of the viral Env protein gives rise to the variable regions. These regions serve to block access to the CD4 binding domain as well as the chemokine receptor binding site, in addition to influencing virus neutralization sensitivity and being responsible for strain specificity of neutralizing antibodies (Guillon, C. et al. 2002 *J Virol* 76:2827-2834; Parren, P. W. H. I. et al. 1999 *AIDS* 13:S137-S162; Wyatt, R. & Sodroski, J. 1998 *Science* 280:1884-1888). Although the variable regions have been defined by their genetic differences among alternative isolates, it is clear that there are subregions within the V loops that show some degree of conservation. This sequence homology is particularly evident in such regions as the tip of the V3 loop (Korber, B. T. et al. 1994 *J Virol* 68:7467-7481). Other motifs can also be identified in various virus strains. For example, specific N-linked glycosylation sites and sequences near the base of the V3 loop are well conserved (Korber, B. T. et al. 1994 *J Virol* 68:7467-7481). In this study, the fine specificity of the variable regions was explored in further detail. Specifically, the V3 loop has been examined with regard to the contribution of the putative stem structures to viral tropism and immunogenicity. We found that a specific mutation that shortens the stem of the V3 loop can alter the tropism of HIV envelope. This mutation, in combination with deletion of the V1 and V2 loops, further enhances the ability of the envelope to elicit a neutralizing antibody response.

Materials And Methods

Antibody. Anti-HIV-1 human monoclonal antibody 2F5 (Purtscher, M. et al. 1996 *AIDS* 10:587-593) and human HIV immunoglobulin G (IgG) were obtained from the National Institutes of Health (NIH) AIDS Research and Reference Reagent Program, Division of AIDS, NIAID, NIH. Anti-HIV p24 antibody KC57-RD1 was obtained from Beckman Coulter, Inc.

Cell and virus stocks. Human embryonic kidney cell 293 was purchased from ATCC, and maintained in Dulbecco's modified Eagle's media (Invitrogen, Carlsbad, Calif.) containing 10% fetal bovine serum (FBS) and 100 μg/ml of penicillin/streptomycin. The human T-cell leukemia cell line MT-2 and the HeLa-derived cell line MAGI-CCR5 were obtained from the AIDS Research and Reference Reagent Program, Division of AIDS, NIAID, NIH.

HIV-1 isolates (ADA, JRCSF, JRFL, Bal, SF162 and 89.6) were obtained from the NIH AIDS Research and Reference Reagent Program, Division of AIDS, NIAID, NIH. Primary isolates 6101 (previously called P15) and 1168 were obtained from David Montefiori of Duke University (Bures, R. et al. 2000 *AIDS Res Hum Retroviruses* 16:2019-2035). The viruses were expanded by two or three cycles of growth on phytohemagglutinin (PHA)- and interleukin (IL-2)-stimulated peripheral blood mononuclear cells (PBMC). For the production of the working stock virus, PBMC were exposed to undiluted virus for 2 h at a concentration of $10^7$ cells/ml. IL-2 culture medium was added to bring the concentration to $10^6$ cells/ml. The IL-2 culture medium was changed every 2 days, and supernatants were collected during the peak of p24 expression, usually 5-10 days after infection. Virus stocks were made cell free centrifugation at 1,000×g and filtration through a 0.45-μm-pore-size filter. In some cases, viral stocks were concentrated by as much as 10-fold using a 100-kDa cutoff polyethersulfone filter (Centricon Plus Biomax filter, Millipore, Bedford, Mass.), according to manufacturer's instructions. Virus aliquots were stored in the vapor phase of liquid nitrogen. Viruses BL01 and BR07 were provided by Dana Gabuzda of the Dana-Farber Cancer Institute. Both are chimeric infectious molecular clones of HIV strain NL4-3 that contain the full-length env genes from primary HIV-1 isolates (Ohagen, A. et al. 2003 *J Virol* 77:12336-12345). After initial plasmid transfection of 293 cells, these viruses were expanded in PBMC as described above.

Buoyant density gradient analysis of lentiviral vectors. 293T cells (3×$10^6$) were transfected with 3 μg each of the relevant Gag and Env expression vectors in a 100-mm-diameter tissue culture dish with Dulbecco's modified Eagle's medium. Three days later, the cell supernatants were collected and mixed with 60% OptiPrep (iodixanol) medium (Invitrogen); the final concentration of OptiPrep was adjusted to a 30% density gradient formed by centrifugation at 45,000×g for 6 h in a VTI50 rotor (used according to the manufacturer's instructions; Invitrogen); and each fraction was collected according to the indicated density. Lentiviral vector proteins were separated in a sodium dodecyl sulphate-4 to 15% polyacrylamide gel electrophoresis (SDS-4 to 15% PAGE) gel, transferred onto an Immobilon-P membrane, and plotted for the expression of Gag (human HIV IgG, used at 1:5,000) and Env (human HIV IgG, used at 1:5,000).

Construction of recombinant adenoviruses. Adenovirus type 5 (Ad5)-based first-generation (ΔE1, ΔE3) recombinant adenoviruses expressing different V loop deletions of gp140 (ΔCFI) were constructed as described previously (Aoki, K. et al. 1999 *Mol Med* 5:224-231). In brief, PacI-linearized shuttle vectors containing V loop deletions of gp140(ΔCFI) were recombined with the right side of Ad5 genomic DNA carried in cosmid by use of Cre recombinase (Novagen, Madison, Wis.). The resulting recombinants were ethanol precipitated, dissolved in Tris-EDTA, and transfected into 293 cells. Recombinant adenoviruses were observed based on plaque formation 10 to 14 days after transfection. Viruses were amplified, purified two times through a CsCl gradient, and stored in PBS+15% glycerol at −20° C.

Production of pseudotyped lentivirus. HIV-Luc pseudotyped with HIV gp160(89.6P) and its V3 deletion mutants were prepared according to published methods (Naldini, L. et al. 1996 *Science* 272:263-267). Briefly, the packaging vector pMD 8.2, pHR-Luciferase, and the envelope-expressing vector were transiently cotransfected into 293T cells by use of calcium phosphate. Supernatants were harvested 48 and 72 h after transfection, filtered, and stored at −80° C. Virus concentrations were determined by an ELISA assay for the p24 antigen (Coulter). The same amount of virus was added onto MT-2 (X4 tropic) and MAGI-CCR5 (R5 tropic) cells, and the cells were incubated for 2 h at 37° C. The cells were harvested 48 h after infection and lysed in cell culture lysis buffer (Promega, Madison, Wis.). The luciferase assay was performed according to the manufacturer's recommendation (Promega, Madison, Wis.).

Plasmid construction. Plasmid pVRC1012-gp140(ΔCFI) (HXB2/BaL chimera) and pVRC1012-gp145(ΔCFI) (HXB2/BaL chimera) have been described previously (Chakrabarti B K et al. 2002 *J Virol* 76:5357-5368). To make gp140(ΔCFI) (Δ$V_1V_2$) and gp145(ΔCFI)(Δ$V_1V_2$), PCR was performed to amplify an XbaI/NheI fragment covering ATG and the boundary of V1 loop using primers 5'CCTCTAGACACCAT-GCGCGTGAAGGAGAAG3' (SEQ ID NO: 15) and 5'CCGCTAGCGTCGGTGCACTTCAGGCT-CACGCACAGGGG3' (SEQ ID NO: 16) and an NheI/ApaI fragment covering the 3' boundary of the V2 loop and the C3 region using primers 5'CCGCTAGCACCAGCTGCAA-CACCAGCGTGATCACCCAG3' (SEQ ID NO: 17) and 5'GGTGCAGGGGCCCTTGCCGTTGAACTTCTT3' (SEQ ID NO: 18). The XbaI/NheI- and NheI/ApaI-digested PCR fragments were cloned into XbaI/ApaI-digested pVRC1012-gp140(ΔCFI) and pVRC1012-gp145(ΔCFI). The resulting plasmids pVRC1012-gp140(Δ$V_1V_2$) and pVRC1012-gp145 (ΔCFI)(Δ$V_1V_2$) have deletions of the V1 and V2 loops as follows: CTDASTSC (SEQ ID NO: 19). Two extra amino acids (AS) were introduced due to introduction of NheI site. A similar approach was used to make other V loop deletion mutants of gp145DCFI (HXB2/BaL chimera) and gp140ΔCFI (HXB2/BaL chimera). The amino acid sequences of deleted V loops are as follows: Δ$V_1$, CTDASKNC (SEQ ID NO: 34); Δ$V_2$, CSFASTSC (SEQ ID NO: 35); ΔV$_3$, CTRASAHC (SEQ ID NO: 36); and ΔV$_4$, CNSASLPC (SEQ ID NO: 37).

V3 deletion mutants were made using the PCR-based Quickchange (Stratagene, La Jolla, Calif.) method according to the manufacturer's instructions. Each mutant was confirmed by double strain sequencing. An ApaI/SexAI fragment containing each confirmed V3 deletion was swapped with a corresponding fragment in pVRC1012-gp140(ΔCFI)(ΔV$_1$V$_2$) and pVRC1012-gp145(ΔCFI)(ΔV$_1$V$_2$). The cDNA encoding gp160(89.6P)(KB9) (Karlsson, G. B. et al. 1997 *J Virol* 71:4218-4225) was synthesized by using human preferred codons. Plasmids expressing different V3 deletion mutants of gp160(89.6P) were made similarly and are shown in FIG. 12. The details for each V3 mutant are listed in FIG. 13A.

ELISA assay. Guinea pig anti-HIV gp140(ΔCFI) ELISA titer was measured by using a modified lectin capture method. Briefly, Immunon 2HB ELISA plates (Thermo Labsystems, Franklin, Mass.) were coated with 100 μl of Galanthus Nivalis lectin (Sigma, St. Louis, Mo.) (10 μg/ml in PBS)/well overnight at 4° C. The plates were blocked with 200 μl of PBS containing 10% FBS for 2 h at room temperature, and washed twice with PBS containing 0.2% TWEEN™-20 (PBS-T). One hundred microliters of tissue culture supernatant from pVRC1012-gp140(ΔCFI)-transfected 293 cells was added in each well and incubated at room temperature for 1 h. The plates were washed 5 times with PBS-T. One hundred microliter serial dilutions of guinea pig immune serum in PBS containing 1% FBS were then added in triplicate and incubated for 1 h at room temperature. After five washes with PBS-T, 100 μl of horseradish peroxidase (HRP)-conjugated F(ab)'2 donkey anti-guinea pig IgG (1:5,000) (Jackson ImmunoResearch Laboratories, West Grove, Pa.) in PBS+1% FBS was added to each well, and incubated for 1 h at room temperature. The plates were washed 5 times with PBS-T, developed by the addition of 100 μl of o-phenylenediamine dihydrochloride (Sigma, St. Louis, Mo.) (one gold and one silver tablet in 20 ml of water) and incubated at room temperature for 30 min. The reaction was stopped by the addition of 100 μl of 1 NH$_2$SO$_4$ to each well. The readout was measured at 450 nm by a SPECTRAmax plate reader (Molecular Devices, Sunnyvale, Calif.). The endpoint dilution was calculated by picking the dilution for which the readout was above that of 1:100 dilution of preimmune serum.

Neutralization assay. The single-round intracellular p24-antigen flow cytometric HIV-1 neutralization assay has been described previously (Mascola, J. R. et al. 2002 *J Virol* 76:4810-4821). Briefly, 40 μl of virus stock was incubated with 10 μl of heat-inactivated guinea pig immune serum (multiplicity of infection, approximately 0.1). After incubation for 30 min at 37° C., 20 μl of PBMC (1.5×10$^5$ cells) was added to each well. PBMC were maintained in IL-2 culture medium containing 1 μM indinavir, and the cells were fed on day 1 with 150 μl of IL-2 culture medium containing indinavir. One day after infection, cells were stained for intracellular p24-antigen with the KC57 anti-p24 antibody, followed by the quantitation of HIV-1 infected cells by flow cytometry. The percent of neutralization was defined as reduction in the number of p24-positive cells compared with the number for wells incubated with corresponding preimmune serum.

To obtain 50% inhibitory concentration (IC$_{50}$) and IC$_{80}$ data, serial dilutions of anti-serum were incubated with virus as described above. Antiserum dose-response curves were fit with a nonlinear function, and the inhibitory dilutions that neutralized 50 and 80% (IC$_{50}$ and IC$_{80}$ respectively) of virus were calculated by a least-squares regression analysis. Statistical analysis of IC$_{50}$ titers was performed using the non-parametric Mann-Whitney rank-order test (GraphPad Prism software package V3.0, GraphPad Software Inc., San Diego, Calif.).

Vaccination. Guinea pigs were immunized intramuscularly with 500 μg (in 400 μl PBS) of gp145 version of plasmid DNA at weeks 0, 2, and 6. At week 14, the guinea pigs were boosted with 10$^{11}$ (in 400 μl PBS) particles of recombinant adenovirus expressing the corresponding gp140 version of the protein. Sera were collected at weeks −2 and 16, divided into aliquots, and frozen at −20° C.

Western Blotting. 293 cells were transfected with plasmid DNA expressing each immunogen by the calcium phosphate method performed according to manufacturer's instructions (Invitrogen). 48 h after transfection, the cells were harvested, washed once with PBS, resuspended in lysis buffer (50 mM HEPES pH 7.0, 150 mM NaCl, 1% NP-40, 1× proteinase inhibitor cocktail), and incubated on ice for 45 min. The cell lysate was centrifuged at 14,000 rpm for 10 min at 4° C. The supernatant was collected, and the protein concentration was measured. 20 μg of protein was mixed with 2× sample loading buffer (100 mM Tris, 4% SDS, 20% glycerol, 5% 2-mercaptoethanol, 0.2% bromophenol blue), and boiled for 5 min. The sample was then resolved by 4 to 15% gradient SDS-PAGE and transferred onto a nitrocellulose membrane (Bio-Rad, Hercules, Calif.). The membrane was blocked twice with Tris-buffered saline (TBS) containing 0.3 TWEEN™-20, 5% skim milk, and 1% bovene serum albumin (BSA) at room temperature for 10 min, followed by incubation with 2F5 antibody (1:2,500) in blocking buffer for 1 h at room temperature. The membrane was washed twice with 100 ml TBS containing 0.3% TWEEN™-20, followed by incubation with HRP-conjugated goat anti-human IgG (Chemicon, Temecula, Calif.) (1:5,000) for 30 min at room temperature. Following two washes with 100 ml of washing buffer, the membrane was developed using ECL Western blotting detection reagents (Amersham, Piscataway, N.J.), and exposed on Hyperfilm ECL (Amersham, Piscataway, N.J.).

Results

Figure 13B:
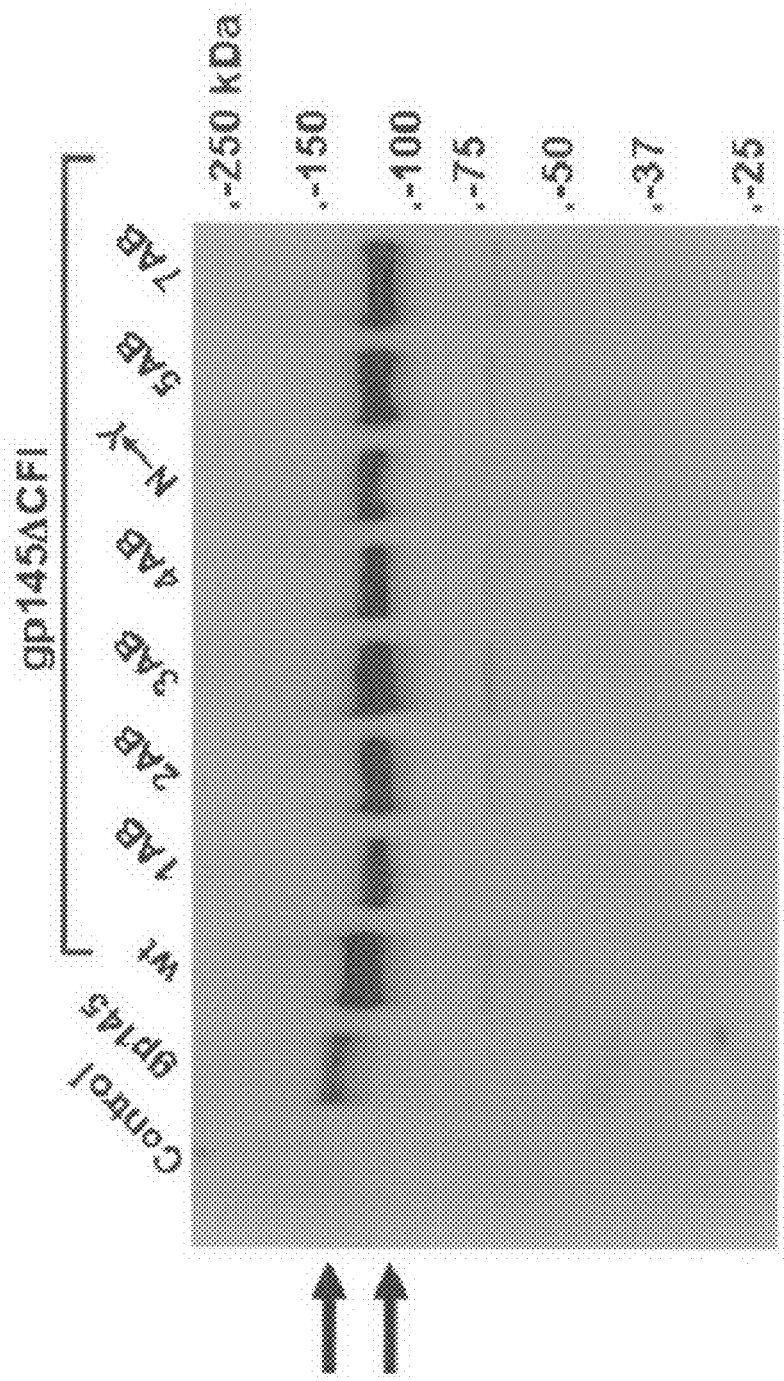
Figure 13C:
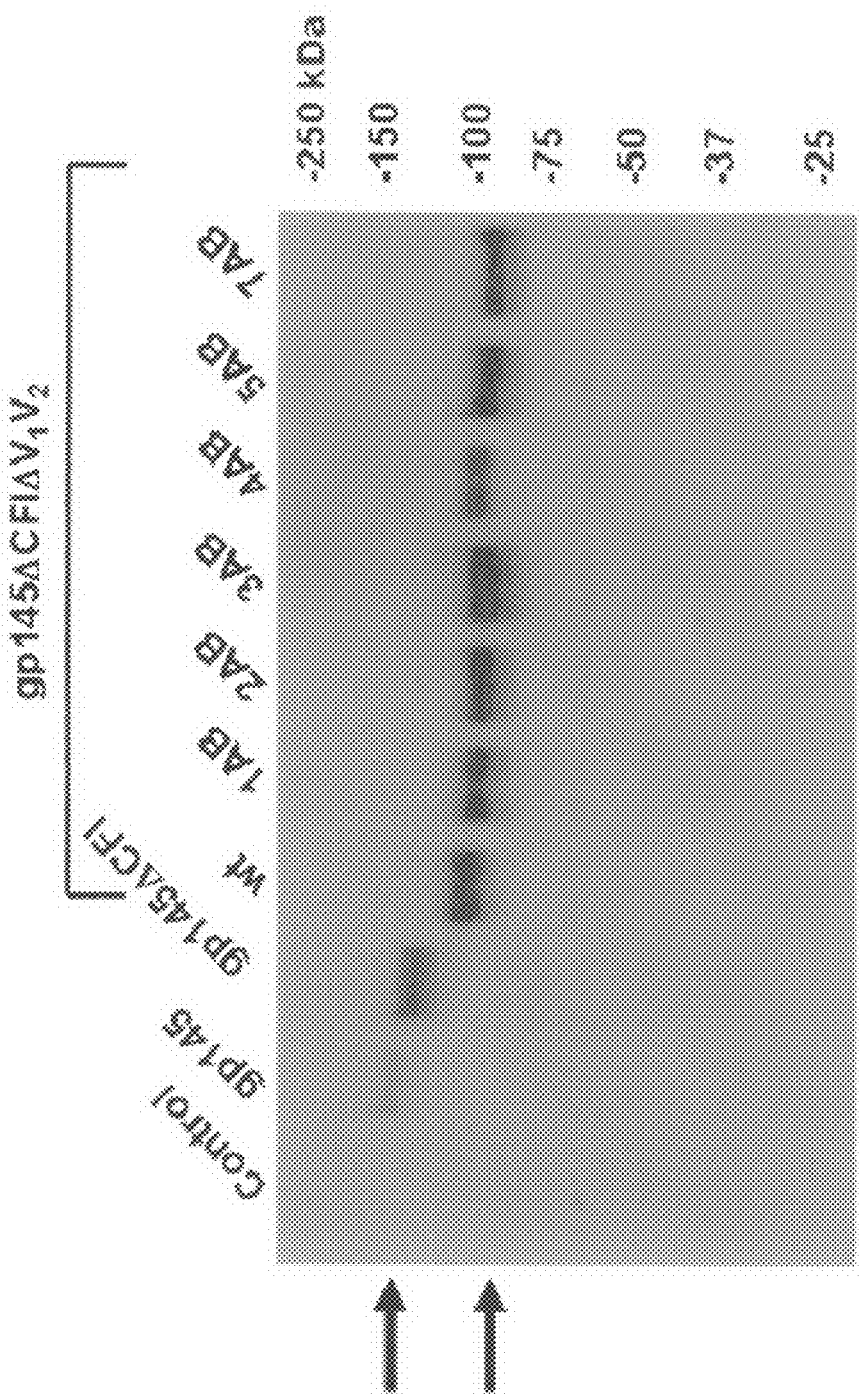

Expression of V region mutants. Modifications of three regions of the HIV envelope, the cleavage site, fusion peptide, and interhelical coiled-coil domain (ΔCFI) were shown previously to enhance the ability of Env to elicit an antibody response (Chakrabarti, B. K. et al. 2002 *J Virol* 76:5357-5368). We evaluated additional mutations either in different V regions or through selective modifications of V3 (FIG. 12). The internal V3 loop deletions were made both in gp145ΔCFI (HXB2/BaL chimera), which was inserted into DNA expression vectors for primary immunization, and in gp140ΔCFI (HXB2/BaL chimera), which was placed into an adenoviral vector for boosting. These series of mutations were also introduced into the strain 89.6P Env (FIG. 13A), a dual-tropic virus that was analyzed initially in functional pseudotyping assays for effects on tropism of different chemokine receptors. The expression of these progressive deletions of the V3 region was assessed by Western blot analysis. Immunoreactive proteins of the expected molecular weight were detected in cell lysates from 293T cells transfected with these expression vectors (FIG. 13B). These same mutations were also introduced into the gp145ΔCFI (HXB2/BaL chimera) with V1 and V2 regions deleted, and protein expression was also confirmed (FIG. 13C).

Figure 14A:
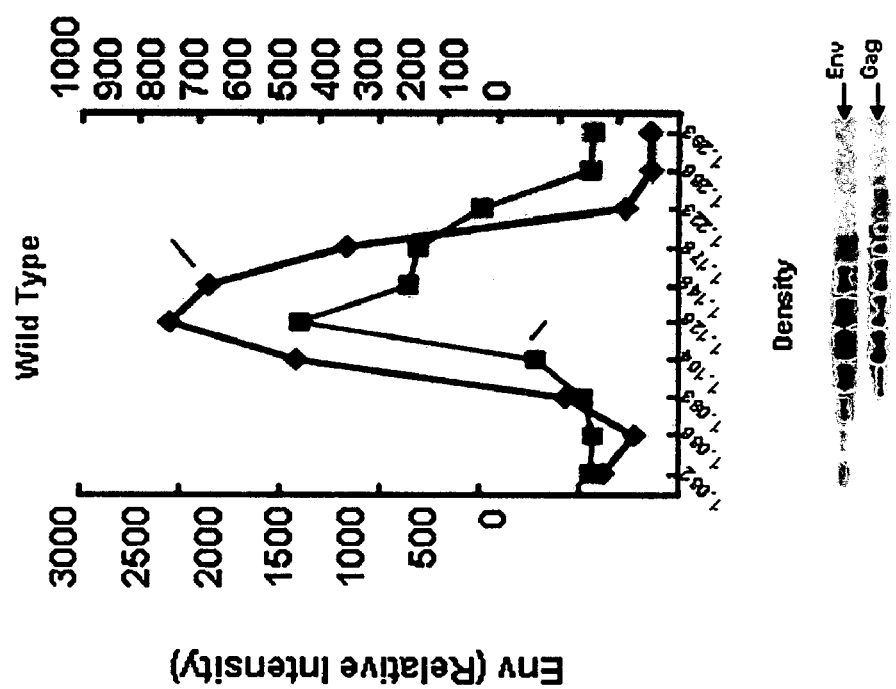
Figures 1, 2, 14C:
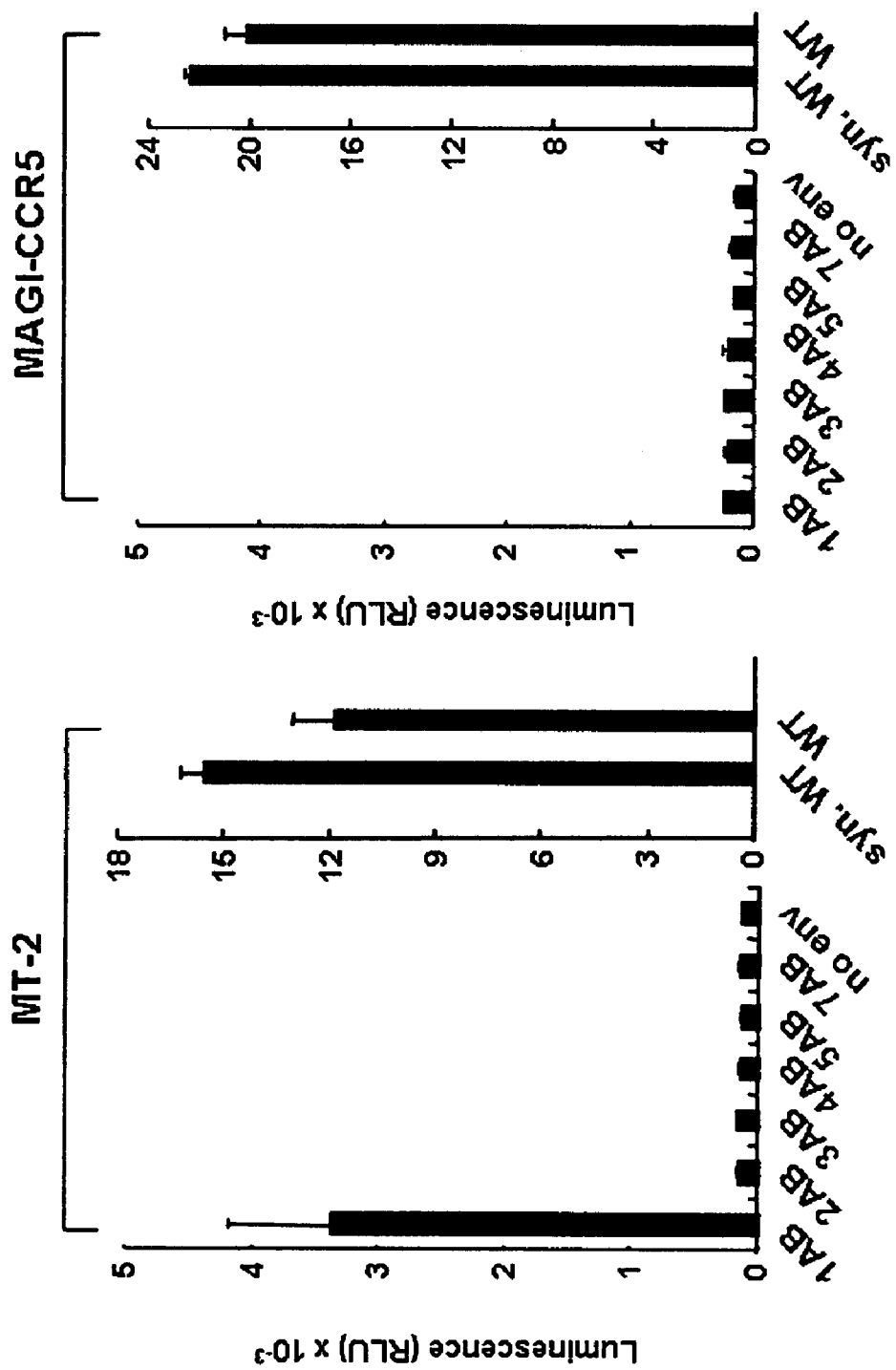

Effects of V3 region mutations on Env function. To evaluate the effects of progressive deletions in the V3 region, the 89.6P Env mutants were analyzed for their ability to mediate viral entry, using an HIV vector encoding a luciferase reporter gene. The abilities of these V3 variants to incorporate into pseudotyped lentivirus were confirmed by buoyant density centrifugation (FIG. 14A, B). Because this Env is dualtropic, both a CXCR4+ cell line, MT-2, and a CCR5+ indicator cell line, MAGI-CCR5, were tested. Although longer deletions of the V3 region abolished the function of the 89.6 Env, the smallest deletion, which removes three amino acids on each side of the V3 loop, termed 1AB, preserved the ability of the Env to infect the CXCR4 target cell, MT-2 (FIG. 14C, left panel). In contrast, even the smallest deletion of the V3 loop abolished its ability to infect MAGI-CCR5 cells (FIG. 14C, right panel). These data indicate that the length of the V3 loop or the deleted amino acids play a critical role in determining its tropism for alternative chemokine receptors, and CCR5 tropism of this Env was more sensitive than CXCR4 tropism.

Figure 15A:
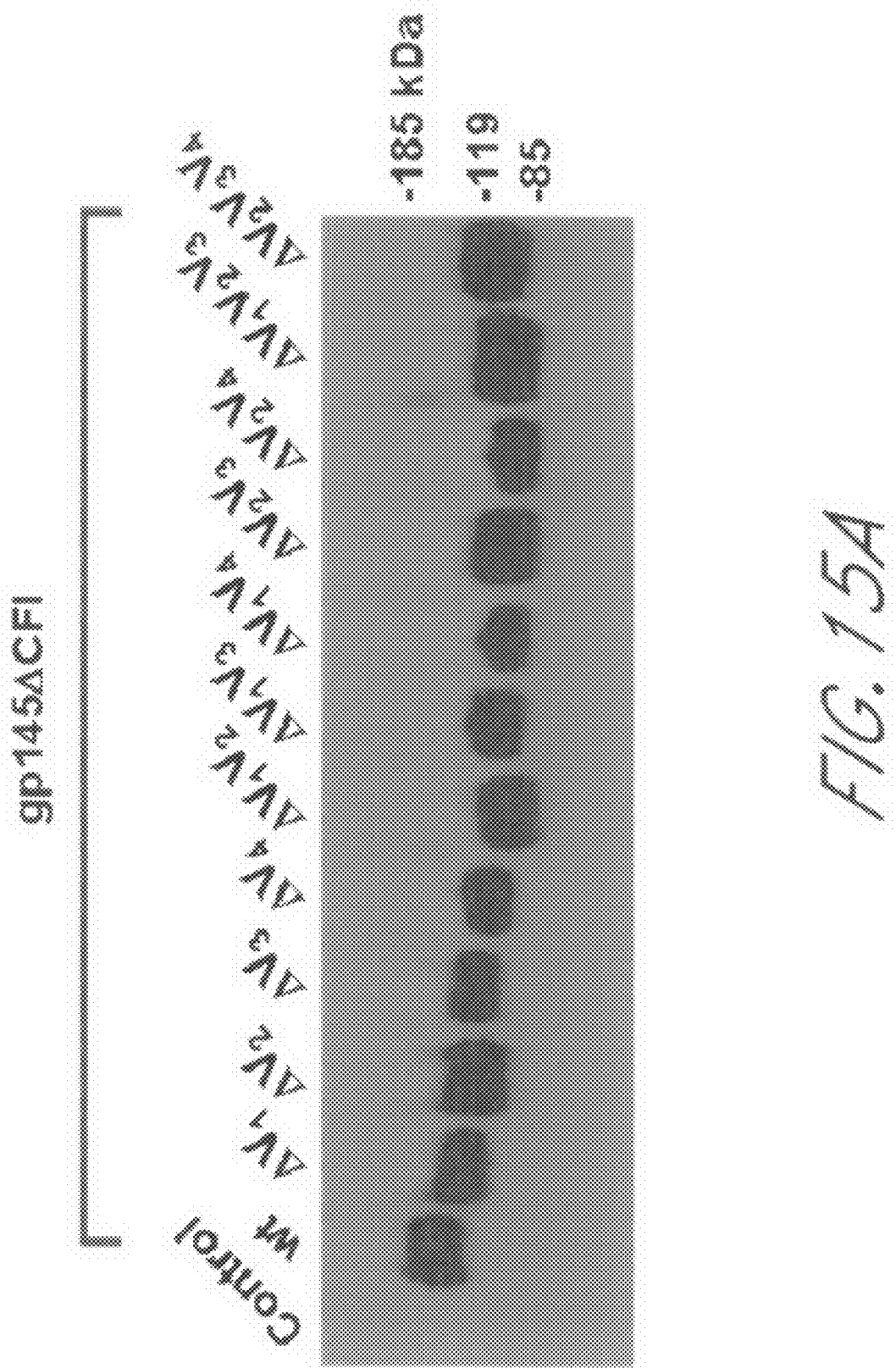
Figure 15B:
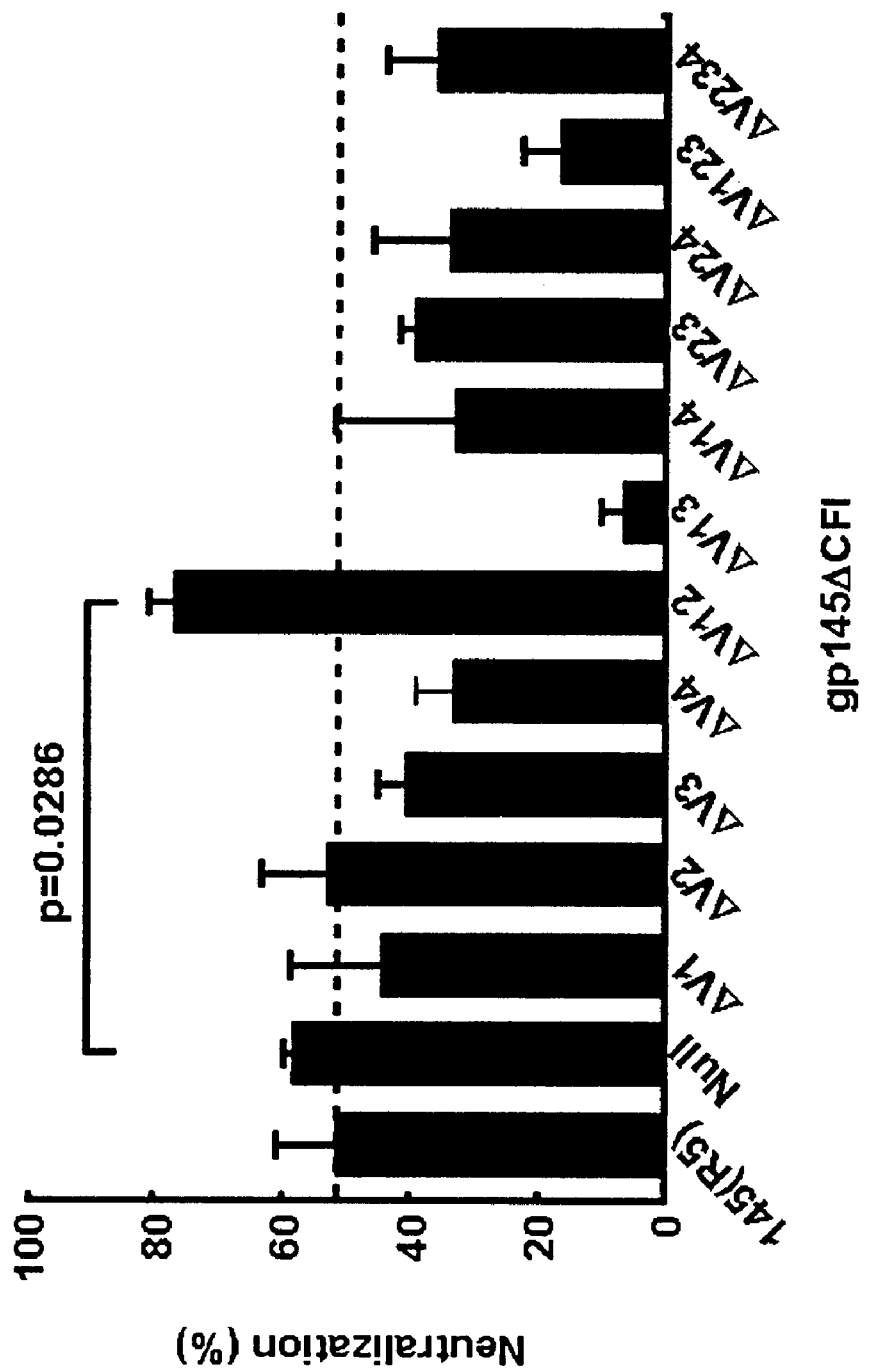
Figure 16A:
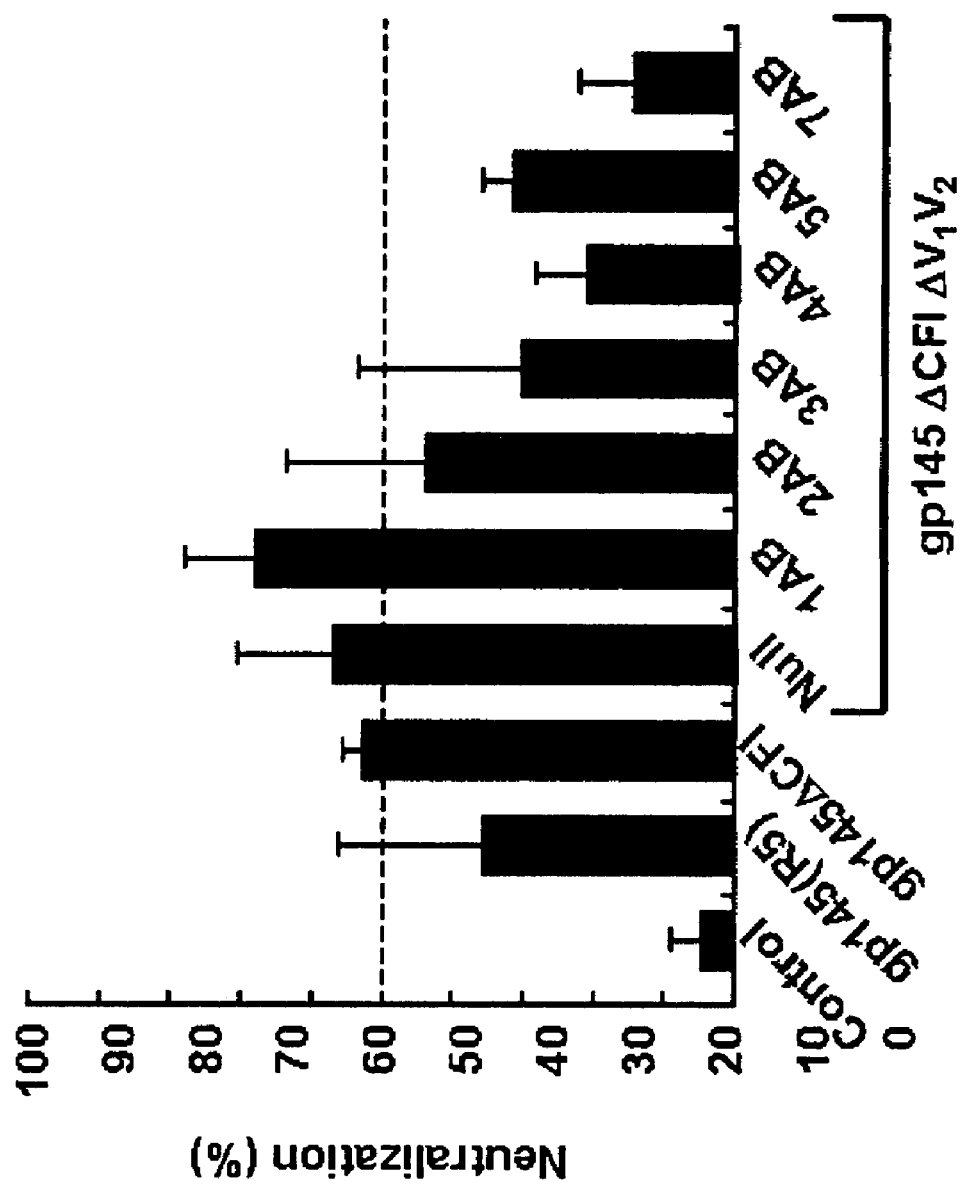
Figure 16B:
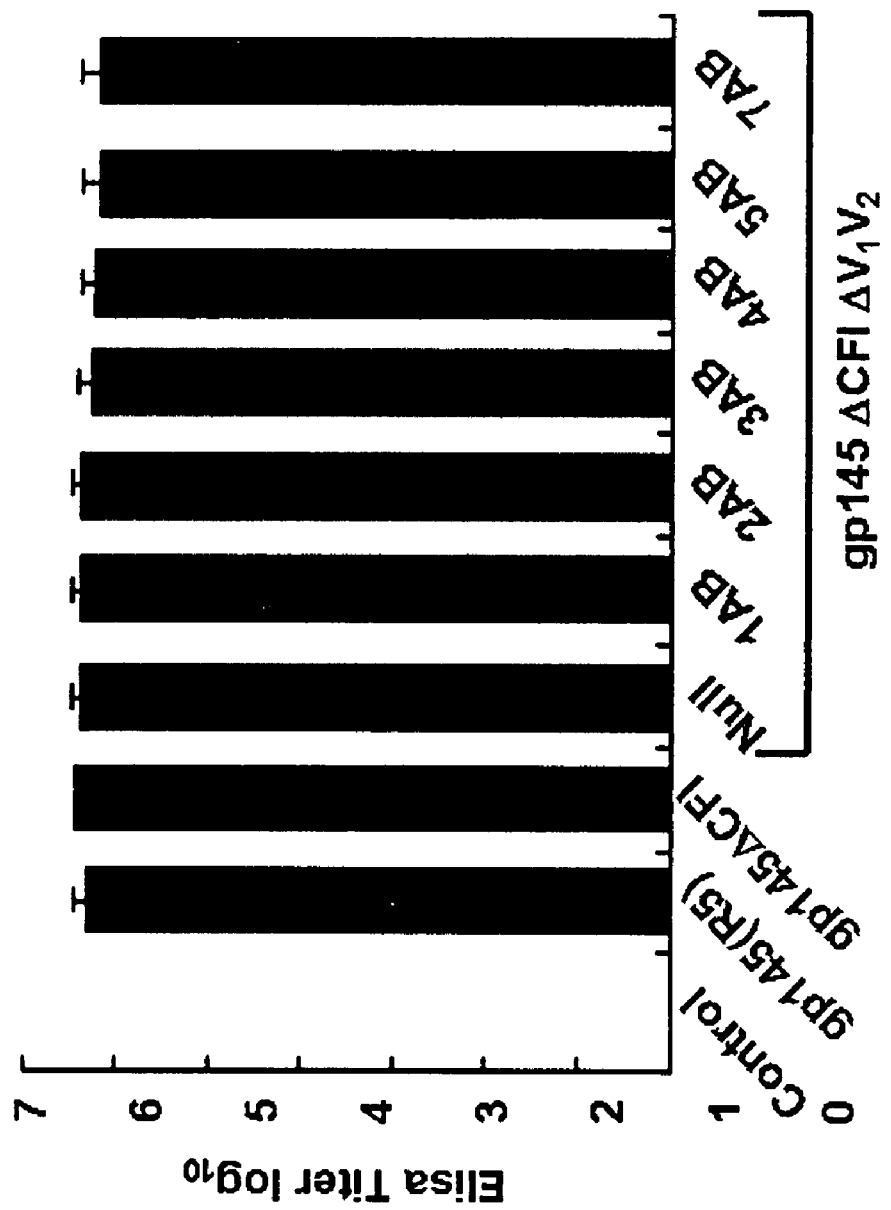

Effect of V region mutations on immunogenicity. To evaluate the effect of these and other V region mutations on the elicitation of a neutralizing antibody response, deletions of different V regions in gp145ΔCFI (HXB2/BaL chimera) and gp140ΔCFI (HXB2/BaL chimera), individually or with combinations of V1 to V4, were made. Expression of the mutants revealed similar levels of protein by Western blotting (FIG. 15A). These V region mutants were assessed for their ability to elicit neutralizing antibodies using DNA/ADV immunization of guinea pigs. The elimination of specific V regions, particularly the combination of V1 and V3, or V1 and V4, markedly reduced their ability to induce a neutralizing antibody response. In contrast, vectors with specific combined deletions, including V1 and V2 regions, increased the neutralizing antibody response to HIV$^{BaL}$ (FIG. 15B). The increased potency of the V1V2 deletion construct was confirmed in further experiments using nine additional primary HIV-1 isolates; these data strongly indicated that this deletion construct provided better immunogenicity than the other constructs shown in FIG. 15B. Based on these analyses additional V3 region mutations were made in the $V_1V_2$ deletion construct and the gp145ΔCFI envelope mutant. When tested against HIV$^{BaL}$ gp145ΔCFI immunogen elicited slightly increased neutralization compared to wild-type gp145, but it did not reach statistical significance (FIGS. 15B and 16A). The less impressive response for $V_1V_2$gp1145ΔCFIΔ seen in FIG. 16A was due to a single nonresponder in a group of four animals. The actual values in FIG. 16A for gp145ΔCFI were 47, 60, 51, and 53, and those for $V_1V_2$gp145ΔCFIΔ were 16, 71, 62, and 77%. However, we confirmed the improved immunogenicity of the Δ$V_1V_2$ mutant in numerous additional experiments. A further increment was suggested when the 1AB mutation was included in the $V_1V_2$gp145ΔCFIΔ immunogen. When larger deletions of the V3 region were made, they became successively less able to elicit a neutralizing antibody response. In contrast, all mutants were able to elicit comparable antibody responses, as determined by ELISA end-point limiting dilution analysis (FIG. 16B).

Figures 1, 2, 3, 4, 17A:
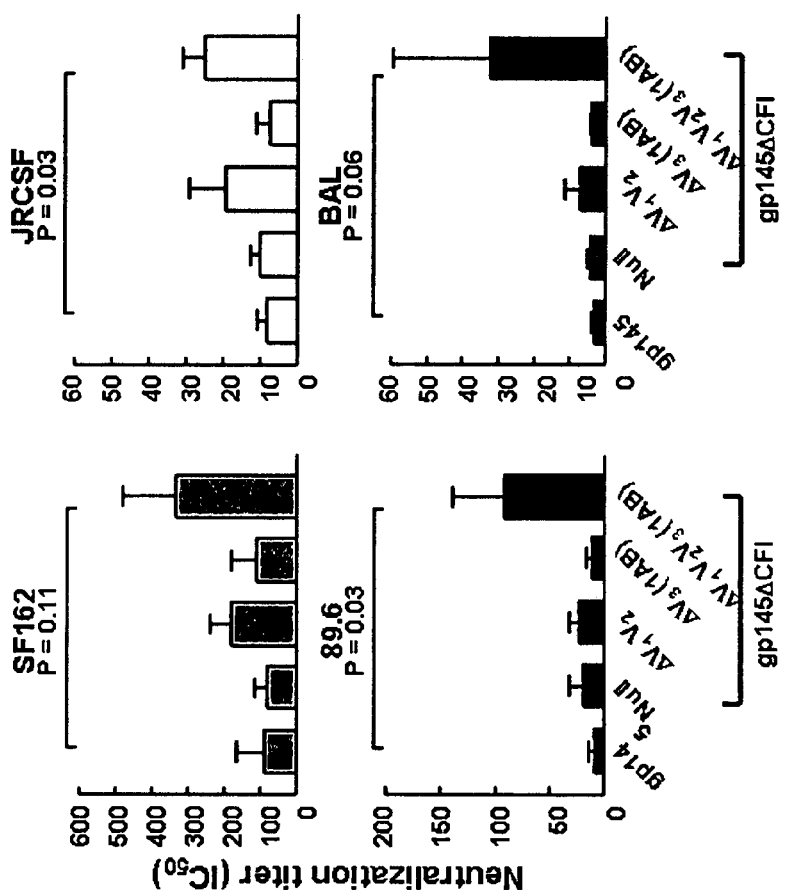

Comparative neutralization profile of the V1V2 and V3(1AB) deletion. To examine the effects of these mutations on the breadth and potency of neutralization, guinea pigs were immunized with selected mutants of the gp145 DNA followed by gp140 adenoviral vector boost, including the wild-type, ΔCFI, or Δ$V_1V_2V_3$(1AB)ΔCFI mutations. These modified Envs were compared for their ability to elicit a neutralizing antibody response. For a comparison of potency of the neutralizing antibody response, serial dilutions of the guinea pig sera were tested against four primary viruses (BaL, JRCSF, 89.6 and SF162), and the respective $IC_{50}$ values were calculated. Among the modified Env immunogens, the Δ$V_1V_2V_3$(1AB)ΔCFI mutant was most effective in inhibiting these four isolates. Compared to the wild-type, the median $IC_{50}$ of this construct was statistically higher against two viruses (P=0.03 for JRCSF and 89.6) and was close to significance for one virus (P=0.06 for BaL) (FIG. 17A). Antisera elicited by this optimal immunogen, Δ$V_1V_2V_3$(1AB)ΔCFI, were examined against a panel of ten primary HIV-1 isolates. The antisera displayed reactivities against a number of unrelated HIV-1 strains. Five of the ten viruses were moderately or strongly neutralized by a 1:5 dilution of guinea pig sera. 50% neutralization was not achieved against three viruses (ADA, 6101 and BL01), and two viruses were neutralized at a low level (50%-60%) by one of the four guinea pig sera, therefore, the immunogen remained limited in its breadth.

Discussion

Figure 17B:
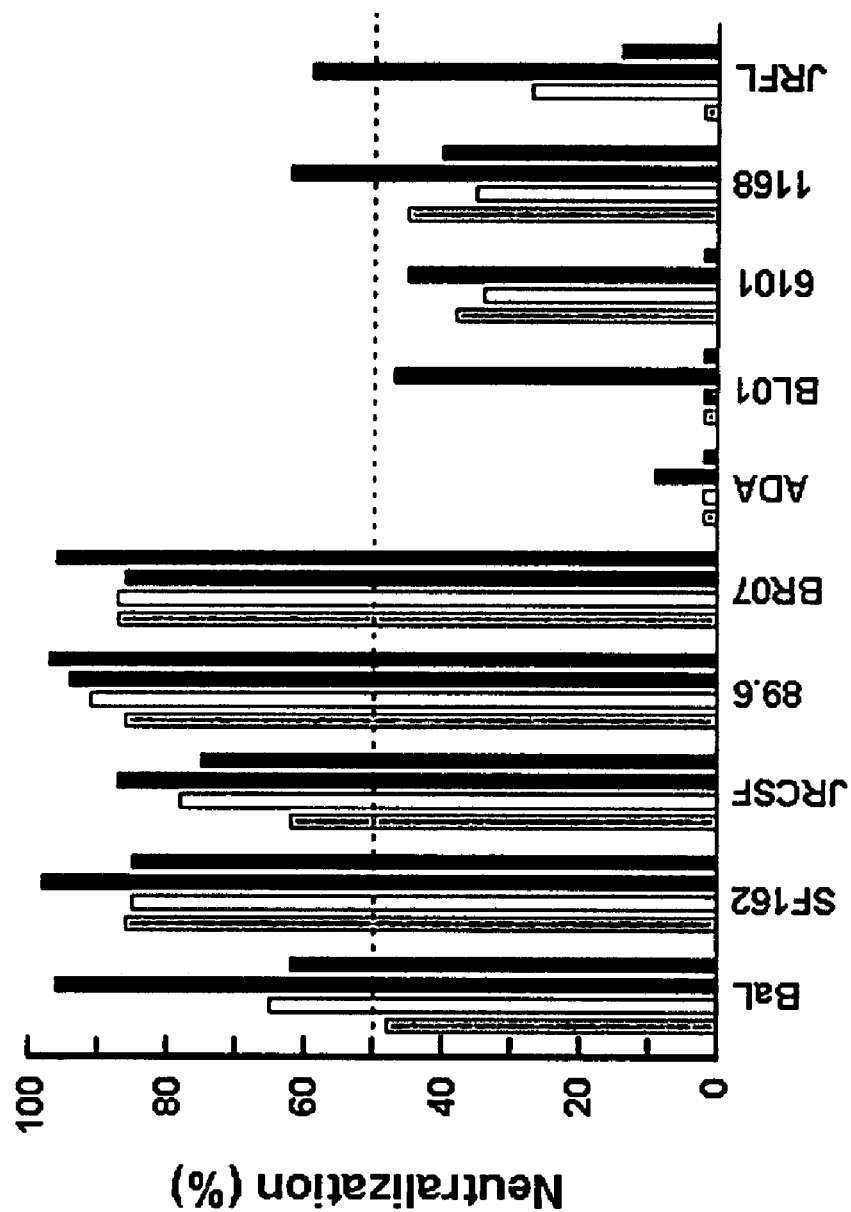

In this study, we have examined the ability of different V-region mutations to alter the immunogenicity of HIV envelope. We have previously shown that mutations in the cleavage site, fusion domain and inter-helical coiled-coil region can enhance immunogenicity by improving the ability of Env vaccines to elicit a neutralizing antibody response (Chakrabarti, B. K. et al. 2002 *J Virol* 76:5357-5368). Although improvements were observed with the ΔCFI mutations in their ability to elicit antibody to Env, the enhancement in the neutralizing antibody was less striking. The goal of the present study was therefore to expand the potency and breadth of the neutralizing response by including additional modifications and systematically evaluating contributions of various V regions and V3 subregions. Truncations in the V3 region markedly altered the functional properties of the HIV89.6P Env. Mutations exceeding six amino acids, three each on opposite sides of the loop, abolished function of both CXCR4- as well as CCR5-tropic viruses. In contrast, the smaller 1AB truncation eliminated the CCR5-tropic activity of this envelope but preserved its ability to target CXCR4+ cells. When the 1AB mutation was evaluated for its ability to elicit neutralizing antibodies after DNA priming and adenoviral vector boosting in guinea pigs, this mutation appeared to have the greatest efficacy in eliciting this response. This effect required additional deletions of V1 and V2, as it was not observed in the gp140/145ΔCFI background. After comparing the potency of different immunogens, the breadth of the optimal candidate was determined against ten representative clade B viral isolates. The breadth of this antisera was increased, with a higher $IC_{50}$ titer and increased reactivity against different HIV isolates (FIG. 17).

Previous studies have indicated that subregions of V3 may be conserved among various isolates and affect Env function. This conservation is evident in specific sequences in this region, for example, the tip of the V3 (Korber, B. T. et al. 1994 *J Virol* 68:7467-7481). Though the V3 region has been shown to affect the tropism of HIV for the chemokine receptor (Briggs, D. R. et al. 2000 *AIDS* 14:2937-2939), the effects of progressive deletions in the V3 loop and its selective effect on CXCR4 targeting have not been previously appreciated. Recently, it has been suggested that conserved conformational determinants are present in the V3 loop of diverse isolates that show similar sensitivity to neutralizing antibodies (Gorny, M. K. et al. 1997 *Immunol* 159:5114-5122; Krachmarov, C. P. et al. 2001 *AIDS Res Hum Retroviruses* 17:1737-1748; Schreiber, M. et al. 1997 *J Virol* 71:9198-9205). For example, the ability of the monoclonal antibody 447-52D and related V3 monoclonal antibodies to inhibit different strains with disparate V3 sequences suggests that common determinants may be shared by genetically disparate strains (Gorny, M. K. et al. 1997 *J Immunol* 159:5114-5122; 8). The enhanced immunogenicity of the V1V2 mutations in this study indicates that there may be masking of the V3 loop by V1 and V2 in HIVBal. Deletion of the V2 region has been suggested in previous studies to improve the antibody response (Srivastava, I. K. et al. 2003 *J Virol* 77:2310-2320), but it is not certain whether similar mechanisms are responsible for those effects and the observations noted here in a different strain in combination with V3 partial deletions, since the additional V1 deletion and the 1AB mutation in V3 further enhances its immunogenicity. The increased breadth of this response indicates that common antigenic determinants are shared by many, though not all, clade B viruses. Taken together, these conserved regions reflect underlying functional requirements and structural homologies between different viruses. Therefore, the families of V3 determinants are envisioned as targets for expansion of the breadth of the neutralizing antibody response.

Part IV

Heterologous Envelope Immunogens Contribute to AIDS Vaccine Protection in Rhesus Monkeys Abstract Because a strategy to elicit broadly neutralizing anti-human immunodeficiency virus type 1 (HIV-1) antibodies has not yet been found, the role of an Env immunogen in HIV-1 vaccine candidates remains undefined. We sought to determine whether an HIV-1 Env immunogen genetically disparate from the Env of the challenge virus can contribute to protective immunity. We vaccinated Indian-origin rhesus monkeys with Gag-Pol-Nef immunogens, alone or in combination with Env immunogens that were either matched or mismatched with the challenge virus. These animals were then challenged with a pathogenic simian-human immunodeficiency virus. The vaccine regimen included a plasmid DNA prime and replication-defective adenoviral vector boost. Vaccine regimens that included the matched or mismatched Env immunogens conferred better protection against $CD4^+$ T-lymphocyte loss than that seen with comparable regimens that did not include Env immunogens. This increment in protective immunity was associated with anamnestic Env-specific cellular immunity that developed in the early days following viral challenge. These data indicate that T-lymphocyte immunity to Env can broaden the protective cellular immune response to HIV despite significant sequence diversity of the strains of the Env immunogens and can contribute to immune protection in this AIDS vaccine model.

Introduction

The diversity of envelope (Env) proteins in human immunodeficiency virus (HIV) isolates worldwide poses a challenge for the development of an effective AIDS vaccine. The failure of traditional vaccine strategies to provide protection against HIV infection is attributable, at least in part, to the genetic heterogeneity of Env (Letvin, N. L. et al. 2002 *Annu Rev Immunol* 20:73-99). Env diversity underlies many of the problems associated with eliciting antibody responses that neutralize a variety of HIV isolates (Mascola, J. R. 2003 *Curr Mol Med* 3:209-216). This diversity also poses difficulties for generating T-lymphocyte responses through vaccination that recognize genetically varied viruses (Letvin, N. L. et al. 2002 *Annu Rev Immunol* 20:73-99). In fact, the problems associated with Env diversity have raised questions about the utility of including an Env immunogen in candidate HIV vaccines.

Nonhuman primates have been powerful models for evaluating HIV vaccine strategies. Studies with macaques have provided evidence for the critical contribution of cellular immunity in controlling AIDS virus replication (Jin, X. et al. 1999 *J Exp Med* 189:991-998; Schmitz, J. E. et al. 1999 *Science* 283:857-860) and have illustrated the ability of vaccines to modify the clinical course of disease even when such vaccines cannot confer frank protection against infection with an AIDS virus isolate (Barouch, D. H. et al. 2000 *Science* 290:486-492; Amara, R. R. et al. 2001 *Science* 292:69-74). Moreover, the rationale for advancing a number of vaccine modalities into early-phase human trials derives from studies in nonhuman primates (Letvin, N. L. et al. 1997 *PNAS USA* 94:9378-9383; Shiver, J. W. et al. 2002 *Nature* 415:331-335).

Recent studies with nonhuman primates have suggested that vaccine-elicited Env-specific immune responses can contribute to containment of simian immunodeficiency virus (SIV) and simian-human immunodeficiency virus (SHIV) replication (Amara, R. R. et al. 2002 *J Virol* 76:6138-6146; Oummanov, I. et al. 2000 *J Virol* 74:2740-275; Polacino, P. et al. 1999 *J Virol* 73:618-630; Polacino, P. S. et al. 1999 *J Virol* 73:8201-8215). However, the experiments were performed with envelopes in the immunogens and challenge viruses that were genetically matched, raising questions about the practical relevance of those observations. The present studies were initiated in the SHIV-rhesus monkey model to evaluate a plasmid DNA prime-recombinant replication-defective adenovirus (ADV) boost immunization strategy for an HIV vaccine. Further, these experiments were done to evaluate the contribution to protection of envelope immunogens that are genetically disparate from the challenge virus. The findings in these studies demonstrate the potency of this vaccine regimen and indicate that T-lymphocyte immunity to Env can broaden the protective cellular immune response to an AIDS virus isolate independent of the sequence of the Env immunogen.

Materials And Methods

Antibody binding and neutralization assays. HIV-1 gp120-specific binding antibodies were quantified by enzyme-linked immunosorbent assay as described previously (Crawford, J. M. et al. 1999 *J Virol* 73:10199-10207). Immunoplates (MaxiSorb F96) (Nunc, Roskilde, Denmark) were coated with BaL-gp120 (Quality Biological, Inc., Gaithersburg, Md.), IIIB-gp120 (Advanced Biotechnologies, Inc., Columbia, Md.), or KB9-gp120 (kindly provided by Patricia Earl, National Institutes of Allergy and Infectious Diseases, Bethesda, Md.). Antibody detection was accomplished with alkaline phosphate-conjugated, goat anti-monkey immunoglobulin G (IgG) (whole molecule; Sigma Chemical Co, St. Louis, Mo.). Neutralizing antibodies were measured in MT-2 cells as described previously (Crawford, J. M. et al. 1999 *J Virol* 73:10199-10207). Briefly, 50 µl of cell-free SHIV-89.6P virus containing 500 50% tissue culture infective doses and grown in human peripheral blood mononuclear cells (PBMCs) was added to multiple dilutions of test plasma in 150 µl of growth medium in triplicate. These mixtures were incubated for 1 h before the addition of $5 \times 10^4$ MT-2 cells. Infection led to extensive syncytium formation and virus-induced cell killing in approximately 6 days in the absence of neutralizing antibodies. Neutralizing titers were calculated as the reciprocal dilution of plasma required to protect 50% of cells from virus-induced killing as measured by neutral red uptake.

Construction of synthetic SIV and HIV-1 genes. The synthetic SIVmac239 gag-pol-nef gene was prepared by using a strategy similar to that used to construct a previously described HIV vaccine vector (Huang, Y. et al. 2001 *J Virol* 75:4947-4951). Briefly, the protein sequences of Gag, Pol, and Nef from SIVmac239 (GenBank accession no. M33262) were reverse translated with the GCG package (Genetics Computer Group, Inc., Madison, Wis.) with codons typically utilized in human cells. Oligonucleotides covering 5169

DNA bp of the theoretical gene with 5' SalI and 3' BamHI sites and a consensus Kozak sequence were synthesized (GIBCO Life Technologies) from multiple fragments, each 75 bp long with 25 nucleotides (nt) of overlap. The codon-modified gag-pol-nef gene was assembled by PCR with Pwo (Boehringer Mannheim) and Turbo Pfu (Stratagene) high-fidelity DNA polymerase. The PCR conditions were optimized with a PCR optimization kit (Stratagene) on a gradient Robocycler (Stratagene). The full-length synthetic gag-pol-nef gene was cloned into the SalI and BamHI site of the mammalian expression vector, pVR1012, and confirmed by DNA sequencing.

A synthetic 89.6P gp145ΔCFI Env gene was made analogously to a previous HIV vector (Huang, Y. et al. 2001 *J Virol* 75:4947-4951; Xu, L. et al. 1998 *Nat Med* 4:37-42). Briefly, the protein sequence of the 89.6P envelope (GenBank accession no. U89134) was reverse translated as described above. Oligonucleotides covering 1,950 DNA bp of the theoretical gene, with a 5' XbaI, a consensus Kozak sequence, and 3' BamHI site, were synthesized (GIBCO Life Technologies): each fragment was 60 bp in length with 20 nt of overlap. In this modified envelope gene, the sequence from nt 1501 (amino acids [aa] 501, R) to 1602 (aa 534, T) and nt 1771 (aa 591, M) to 1851 (aa 617, V) with respect to start codon ATG (A as nt 1) were deleted. This deletion removes the cleavage site and fusion peptide for the envelope as well as part of the interspace between the two heptad repeats. The protein was terminated at nt 2124 (aa 702, 1). The amino acid at 617 was changed to E from D due to the creation of XhoI cloning sites. The codon-modified gp145ΔCFI gene was assembled by PCR as described above. The synthetic gp145ΔCFI gene was cloned into the XbaI and BamHI sites of the mammalian expression vector pVR1012, and the sequence was confirmed by DNA sequencing. The synthetic 89.6 Pgp140ΔCFI gene was derived from the gp145ΔCFI plasmid with introduction of a termination codon after nt 2046 (aa 676, W).

The synthetic CCR-5-tropic clade B immunogen was derived from both HXB2 and Bal strain envelopes. The protein sequence of the clade B Env glycoprotein (gp160) from HXB2 (X4-tropic; GenBank accession no. K03455) was used to create a synthetic version of the gene (X4gp160/h). The nucleotide sequence of X4gp160/h shows little homology to the HXB2 gene, but the protein encoded is the same, with the following amino acid substitutions: aa 53 (phenylalanine→leucine), aa 94 (asparagine→aspartic acid), aa 192 (lysine→serine), aa 215 (isoleucine→asparagine), aa 224 (alanine→threonine), aa 346 (alanine→aspartic acid), and aa 470 (proline→leucine). These seven amino acid substitutions were present in the Los Alamos sequence database at the time those genes were synthesized. To produce an R5-tropic version of the envelope glycoprotein (R5gp160/h), the region encoding HIV-1 envelope glycoprotein aa 205 to 361 from X4gp160/h (VRC-3300, described in WO 02/32943) was replaced with the corresponding region from the BaL strain of HIV-1 (GenBank accession no. M68893, again using human preferred codons). The full-length R5-tropic version of the envelope gene from pR5gp160/h (VRC-3000, described in WO 02/32943) was terminated after the codon for aa 704. The truncated envelope glycoprotein (gp145) contained the entire SU protein and a portion of the TM protein, including the fusion domain, the transmembrane domain, and regions important for oligomer formation. (H1 and H2 and their interspace are required for oligomerization.) Subsequently, the fusion and cleavage domains from aa 503 to 536 were deleted. The interspace between H1 and H2 from aa 593 to 620 was also deleted. The gp140 ΔCFI version was derived from this sequence by introduction of a termination codon as previously described (Chakrabarti B K et al. 2002 *J Virol* 76:5357-5368).

Construction and purification of the rADVs. Recombinant ADVs (rADVs) were generated by a modification of a previously published method (Ohno, T. et al. 1994 *Science* 265:781-784; Sullivan, N. J. et al. 2000 *Nature* 408:605-609). Briefly, the synthetic SIVmac239 gag-pol adapted from the sequence described above (terminated at aa 1451) was cut with SalI, blunted, and then digested with BamHI, after which it was subcloned into the blunted EcoRV and BamHIH sites of the shuttle plasmid pAdAdaptCMVmcs. Synthetic HIV-1 gp140ΔCFI adapted from the sequence described above was subcloned into the shuttle vector by using the XbaI and BamH1 sites. 293T cells were plated onto six-well plates and cultured to about 30% confluence, and then cotransfected with 2 μg of twice-cesium chloride-purified and linearized shuttle plasmid with ADV cosmid by the calcium phosphate method. After 7 to 12 days, the supernatant containing recombinant adenovirus was collected from the cell lysate with freezing and thawing at least three times in 0.6 ml of Tris-HCl, pH 8.0. The production of recombinant adenovirus was scaled up by infection of 293T cells with the virus-containing supernatant. The viruses were purified by cesium chloride, aliquoted as 1012 particles/ml, and stored in phosphate-buffered saline (PBS) with 13% glycerol at −20° C. for future use.

Expression of plasmid and rADV Env vaccine constructs. Expression of plasmids encoding gp145ΔCFI(R5) and gp145ΔCFI(89.6P) was measured after transfection of 293T cells (in a six-well-dish) with a calcium phosphate transfection reagent (Invitrogen) with 2 μg of each plasmid. Forty-eight hours after transfection, cells were collected, lysed in cell lysis buffer (50 mM HEPES, 150 mM NaCl, 1% NP-40, 1× protease inhibitor cocktail [Roche]), and resolved by 4 to 15% polyacrylamide gradient sodium dodecyl sulfate-polyacrylamide gel electrophoresis. Proteins were transferred onto a nitrocellulose membrane (Bio-Rad), followed by Western blot analysis with human HIV IgG as the primary antibody at a 1:2,000 dilution. For comparison of the rADVs expressing these Env immunogens, A549 cells were infected at 5,000 particles/cell. Forty-eight hours after infection, cell lysates were prepared and Western blotting was performed as described above.

ELISPOT assays. Ninety-six well multiscreen plates were coated overnight with 100 μl (per well) of 5 μg/ml anti-human gamma interferon (IFN-γ) (B27; BD Pharmingen) in endotoxin-free Dulbecco's phosphate-buffered saline (D-PBS). The plates were then washed three times with D-PBS containing 0.25% TWEEN™ 20 (D-PBS/Tween), blocked for 2 h with D-PBS containing 10% fetal bovine serum to remove the TWEEN™ 20, and incubated with peptide pools and $2\times10^5$ PBMCs in triplicate in 100-μl reaction volumes. Individual peptide pools covered the entire SIVmac239 Gag, Nef, and Pol proteins and both the HIV-1 HXB2/BaL and HIV-1 89.6P (KB9) Env proteins. Each pool comprised 15-aa peptides overlapping by 11 aa, except for the HIV-1 89.6P Env pool, which comprised 20-aa peptides overlapping by 10 aa. Each pool contained no more than 130 peptides. Each peptide in a pool was present at a concentration of 1 μg/ml. Following an 18-h incubation at 37° C., the plates were washed nine times with D-PBS/TWEEN™ and once with distilled water. The plates were then incubated with 2 μg of biotinylated rabbit anti-human IFN-γ/ml (Biosource) for 2 h at room temperature, washed six times with Coulter Wash (Beckman Coulter), and incubated for 2.5 h with a 1:500 dilution of streptavidin-alkaline phosphate (Southern Biotechnology). After five washes with Coulter Wash and one wash with PBS, the plates were developed with nitroblue tetrazolium-5- bromo-4-chloro-3-indolylphosphate chromogen (Pierce), stopped by washing with tap water, air dried, and read with an enzyme-linked immunospot (ELISPOT) reader (Hitech Instruments) using Image-Pro Plus image processing software (version 4.1) (Media Cybernetics, Des Moines, Iowa). The number of spot-forming cells (SFC) per $10^6$ PBMCs was calculated. Medium background levels were consistently less than 15 SFC/$10^6$ PBMCs.

$CD4^+$ T-lymphocyte counts and viral RNA levels. Counts of $CD4^+$ T lymphocytes were determined by monoclonal antibody staining and flow cytometry. Plasma viral RNA levels were measured by an ultrasensitive branched DNA (bDNA) amplification assay with a detection limit of 500 copies per ml (Bayer Diagnostics).

Statistical analysis. The Kruskal-Wallis test for three or four groups (or its equivalent Wilcoxon rank sum test for two groups) was used to compare the CD4 T-lymphocytes, peak viral RNA, set point viral RNA, and ELISPOT counts between vaccine groups. The Wilcoxon test for censored data was used to compare time to detectable neutralizing antibodies between vaccine groups. The Fisher exact test was used to compare the presence of detectable neutralizing antibodies at day 20 or within the first 42 days. Linear regression (ordinary least squares) was used to relate neutralizing antibodies and ELISPOT counts to CD4 T-lymphocyte counts and (separately) to $\log_{10}$ plasma viral RNA; the Wald test was used to obtain significance levels. Power calculations for the Kruskal-Wallis and Wilcoxon tests were based on the fact that the worst asymptotic relative efficiency of these tests versus Gaussian-based tests is 0.86.

Results

Figure 18:
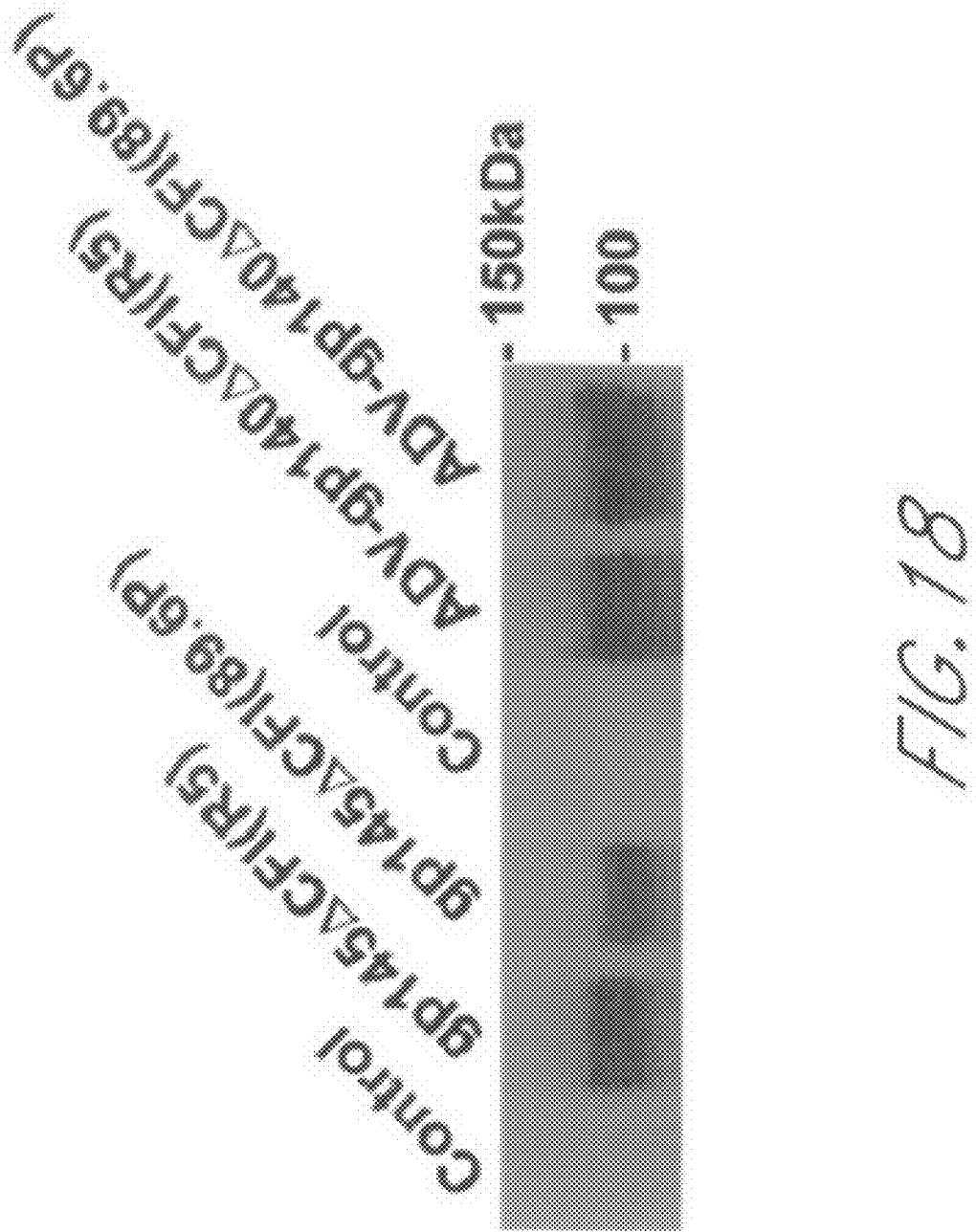
Figure 19A:
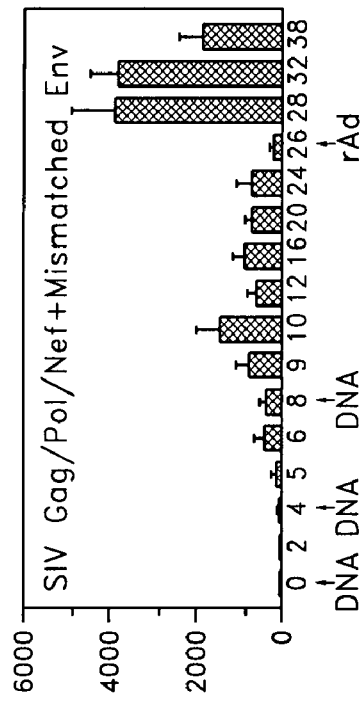
Figure 19B:
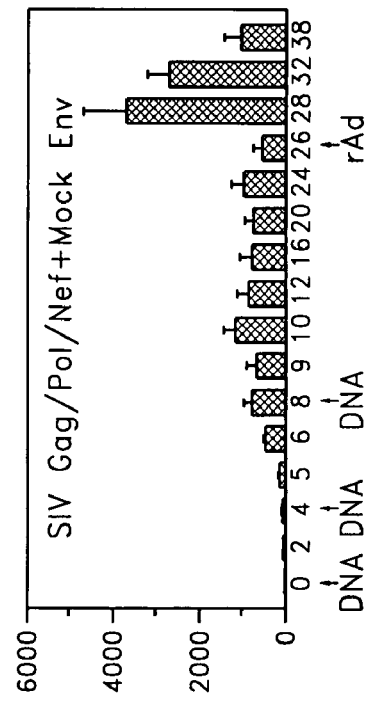
Figure 19C:
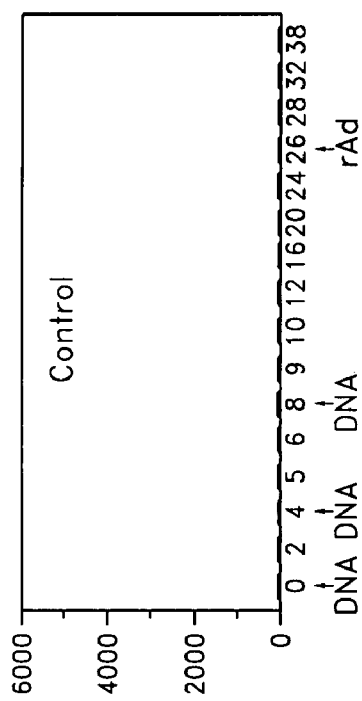
Figure 19D:
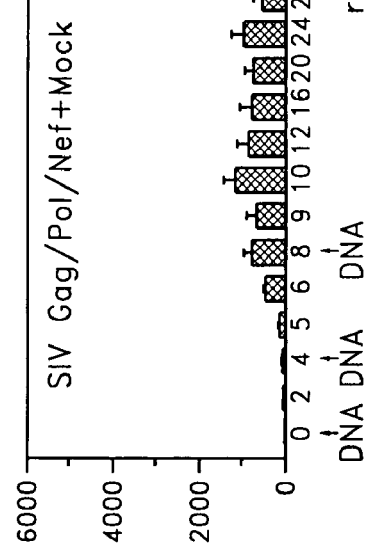

Twenty-four Indian-origin rhesus monkeys, none of them expressing the major histocompatibility complex class I allele Mamu-A*01, were analyzed in four experimental groups that received DNA priming followed by rADV vector boosting with the following immunogens: (i) control, (ii) Gag-Pol-Nef with no Env (mock), (iii) Gag-Pol-Nef with SHIV-89.6P Env (matched), or (iv) Gag-Pol-Nef with HXB2/BaL Env (mismatched). The DNA plasmid used in this study encoded a Gag-Pol-Nef fusion protein, but because of the instability of rADV constructs expressing Gag-Pol-Nef, the ADV vectors used in this study expressed only Gag-Pol. All HIV or SIV genes used in these vaccine constructs were codon modified as previously described to optimize expression in mammalian cells (Chakrabarti, B. K. et al. 2002 *J Virol* 76:5357-5368; Huang, Y. et al. 2001 *J Virol* 75:4947-4951). A modified form of the env gene, with mutations in the cleavage site, fusion, and interhelical domains (ΔCFI), shown to increase antibody responses to Env, was used in all expression vectors. Since these monkeys were eventually challenged with SHIV-89.6P, we refer to the HIV-1 89.6P Env immunogens as "matched" and the HIV-1 HXB2/BaL Env immunogens as "mismatched." To produce the HXB2/BaL Env, the region encoding aa 205 to 361 from the HXB2 Env was replaced with the corresponding region from the BaL strain of HIV-1. In fact, the 89.6P and HXB2/BaL ΔCFI Env proteins are only 81% identical. The ADV vector contained a deletion in E1 to render the vector replication defective and a partial deletion/substitution in E3 that disrupts the coding sequences for the E3 proteins (Crawford, J. M. et al. 1999 *J Virol* 73:10199-10207; Ourmanov, I. et al. 2000 *J Virol* 74:2740-2751). The rADV expressing either the HXB2/BaL or 89.6P gp140 ΔCFI was made as described previously (Polacino, P. et al. 1999 *J Virol* 73:618-630; Polacino, P. S. et al. 1999 *J Virol* 73:8201-8215). The related gag-pol or identical env cDNA inserts were introduced and matched to the immunogens in the plasmid used for DNA priming as previously described (Amara, R. R. et al. 2002 *J Virol* 76:6138-6146; Barouch, D. H. et al. 2000 *Science* 290:486-492). Each plasmid DNA was delivered intramuscularly as a 4-mg inoculum with a needleless Biojector device (Biological; Bioject Medical Technologies, Inc., Beckminister, N.J.) on a schedule of weeks 0, 4, and 8. The levels of in vitro expression of the HXB2/Bal and 89.6P env genes were comparable in both the plasmid and rADV vaccine constructs (FIG. 18). A single inoculation of $10^{12}$ particles of each rADV construct was given intramuscularly to each monkey on week 26.

The immunogenicity of these vaccine constructs was assessed by antibody binding, virus neutralization, and pooled-peptide ELISPOT assays. Plasma obtained 2 weeks after the rADV boost was assessed for BaL and 89.6P gp120 binding and for neutralization of the SHIV-89.6P challenge virus. While the Env-immunized monkeys developed high-titer antibodies to the immunizing BaL or 89.6P gp120, plasma from week 28 of the study, the time of peak ELISA titer antibody responses, failed to neutralize the challenge virus SHIV-89.6P.

Figures 20A, 20B:
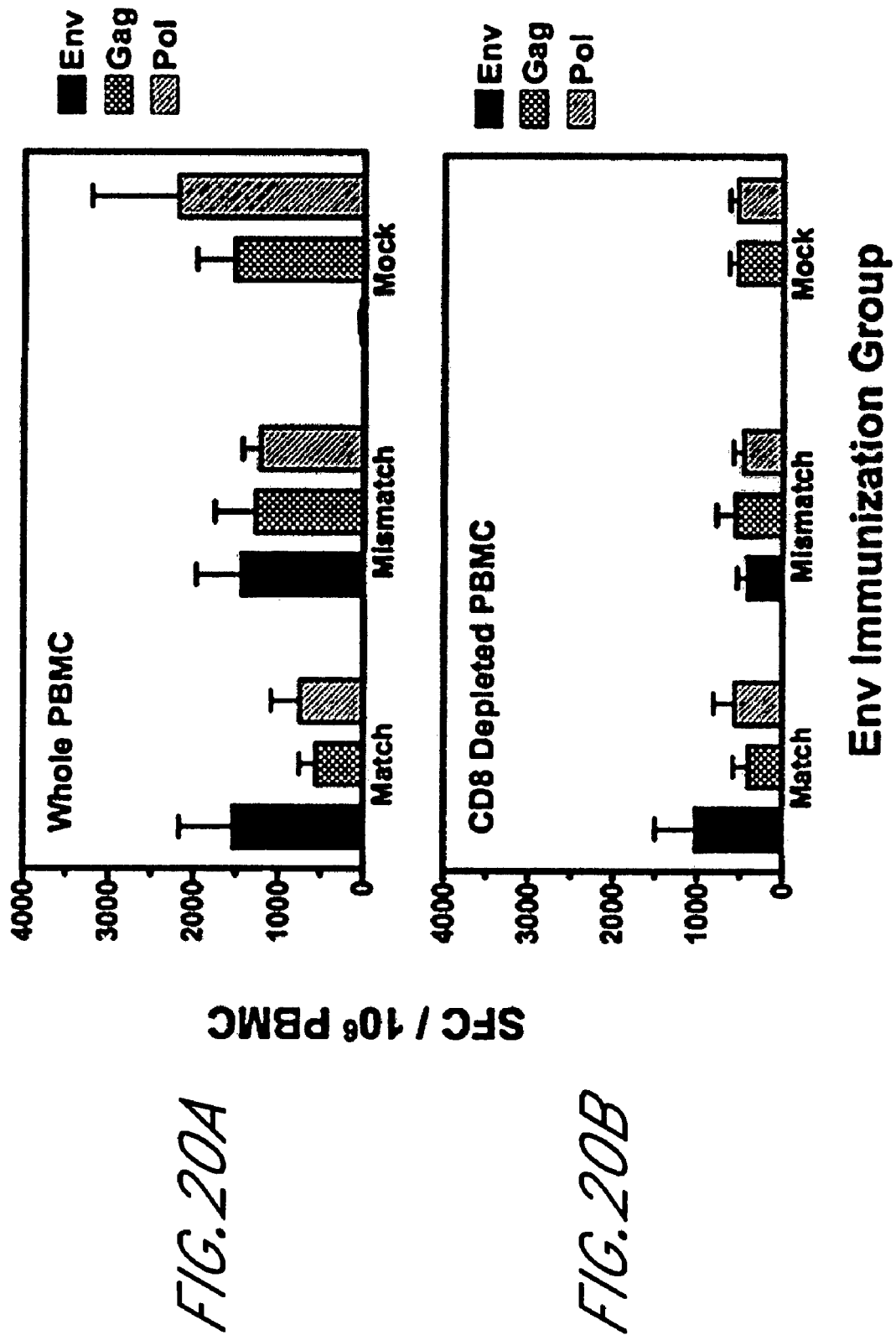

ELISPOT responses by the PBMCs of all monkeys receiving experimental immunogens were robust (FIG. 19). Cellular immunity to SIV Gag, Pol, and Nef was generated in all groups of vaccinated monkeys, and that to HIV-1 89.6P and HXB2/BaL Env was generated in monkeys receiving these respective Env immunogens. Monkeys injected with the mock Env (empty vectors) did not develop Env-specific cellular immunity. Mean total vaccine-elicited PBMC ELISPOT responses to all viral proteins 2 weeks after the final plasmid DNA inoculations were 942±294 SFC (mean±standard error) in the matched Env group, 1,588±554 SFC in the mismatched Env group, and 1,255±264 SFC in the mock Env group. Two weeks after boosting with the rADV vectors, total ELISPOT responses were 2,892±1,116, 3,993±1,000, and 3,800±984 SFC in these respective groups, a >2.5-fold increase over the cellular immune responses elicited by DNA priming alone. These responses represented both $CD4^+$ and $CD8^+$ T-lymphocyte responses, as demonstrated in ELISPOT assays performed on unfractionated and $CD8^+$ T-lymphocyte-depleted PBMCs from the monkeys (FIGS. 20A and B). While the responses declined in subsequent weeks, high-frequency responses were still detected in PBMCs of the monkeys at the time of viral challenge (1,581±535, 1,908±557, and 1,092±400 SFC, respectively) in these three groups of monkeys. Thus, this vaccine regimen elicited high-frequency $CD4^+$ and $CD8^+$ T-lymphocyte responses to multiple viral proteins. No statistically significant differences in total ELISPOT responses were observed between the three groups of experimentally vaccinated monkeys. The particularly high total SFC responses of the PBMCs of the monkeys in the mock Env group of animals reflected idiosyncratically high responses to the Pol protein (FIG. 20A). Importantly, there were no significant differences between groups of monkeys in the magnitude of their Gag- and Pol-specific ELISPOT responses as determined by comparison with a Mann-Whitney t test.

Figure 21:
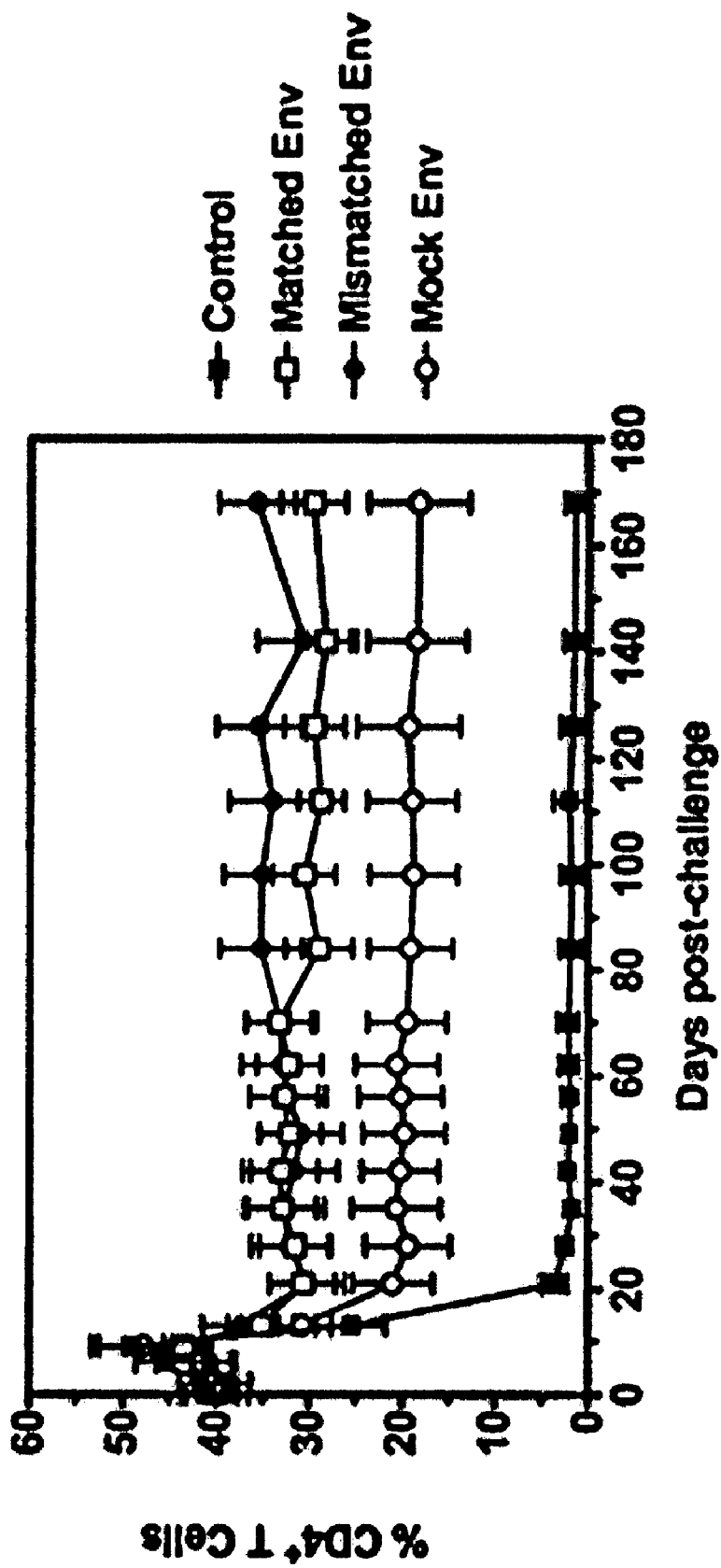

All monkeys were challenged intravenously with 50 50% monkey infective doses SHIV-89.6P on week 38, 12 weeks following the rADV boost, and were monitored for clinical, virologic, and immunologic sequelae of infection. SHIV-89.6P infection causes a precipitous decline in peripheral blood $CD4^+$ T lymphocytes in approximately 75% of immunologically naive rhesus monkeys, and selected vaccine strategies can generate immune responses that blunt this $CD4^+$ T-lymphocyte loss (Amara, R. R. et al. 2001 *Science* 292:69-74; Barouch, D. H. et al. 2000 *Science* 290:486-492;

Reimann, K. A. et al. 1996 *J Virol* 70:6922-6928; Shiver, J. W. et al. 2002 *Nature* 415:331-335). We therefore monitored peripheral blood CD4$^+$ T-lymphocyte counts as an indicator of the clinical status of the monkeys following SHIV-89.6P infection (FIG. 21). A profound loss of CD4$^+$ T lymphocytes was observed in all controls, while substantial blunting of that CD4$^+$ T-lymphocyte depletion was seen in four of the six monkeys receiving the vaccinations with SIV Gag-Pol-Nef plus mock Env. Therefore, as expected based on previous studies (Amara, R. R. et al. 2001 *Science* 292:69-74; Barouch, D. H. et al. 2000 *Science* 290:486-492; Shiver, J. W. et al. 2002 *Nature* 415:331-335), vaccine-mediated protection against clinical sequelae of SHIV-89.6P infection was conferred by the Gag-Pol-Nef-containing immunogens. The two groups of vaccinated monkeys that received HIV-1 Env in addition to SIV Gag-Pol-Nef immunogens demonstrated even more impressive protection against CD4+ T-lymphocyte loss than the monkeys receiving only the SIV Gag-Pol-Nef immunogens (FIG. 21). The mean peripheral blood CD4$^+$ T-lymphocyte counts on day 168 postchallenge in the groups of experimentally vaccinated monkeys were 363±100 (mean±standard error) in the mock Env-vaccinated animals, 772±111 in the matched Env-vaccinated animals, and 706±76 in the mismatched Env-vaccinated animals, documenting that statistically significant protection against CD4$^+$ T-lymphocyte loss was afforded by inclusion of an Env component in the vaccine (P=0.03, Kruskal-Wallis test). Importantly, the monkeys that received the mismatched Env immunogens showed comparable protection to those injected with the matched Env immunogens.

Figure 22:
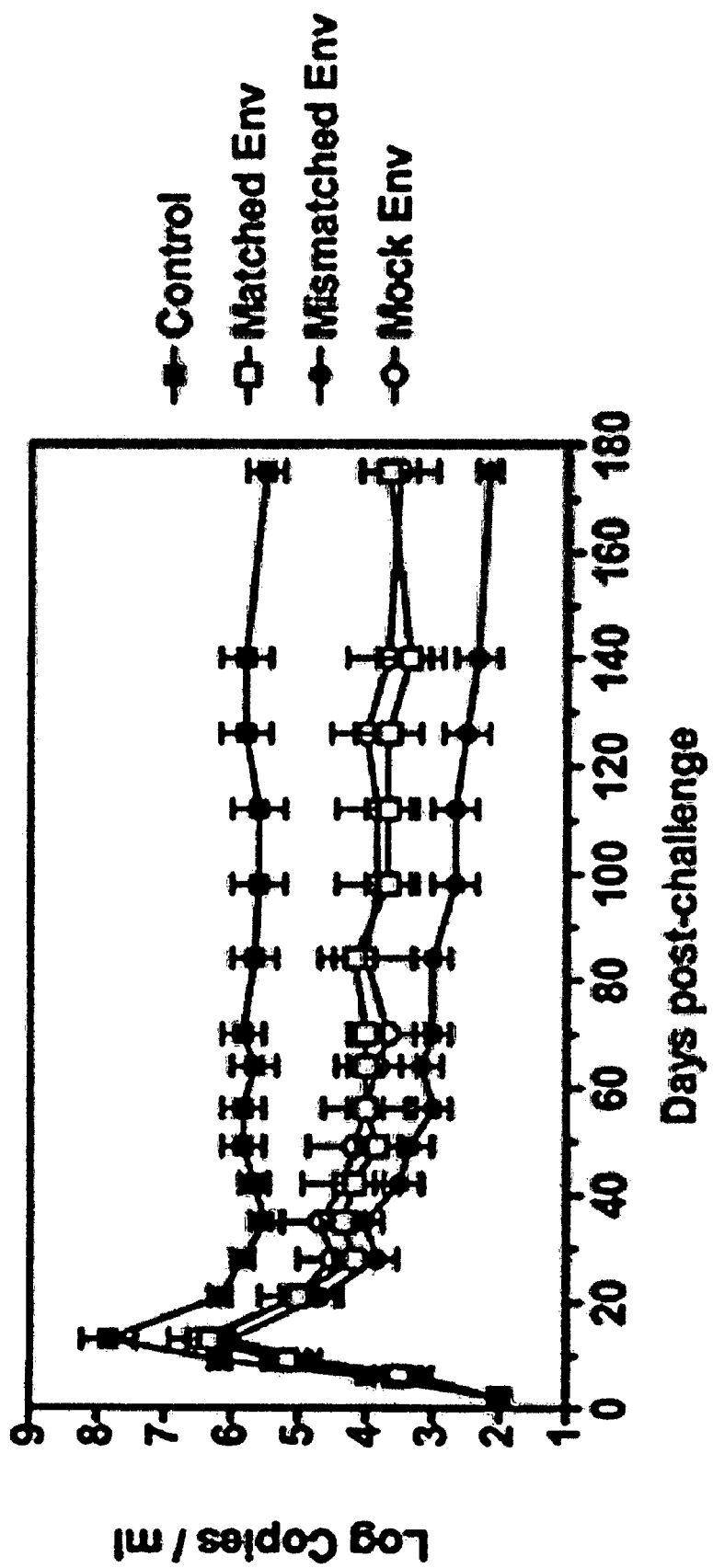

Viral replication in the SHIV-89.6P-challenged monkeys was assessed by quantitating viral RNA in their plasma by using a bDNA assay (FIG. 22). Since only 15% of immunologically naïve rhesus monkeys control this virus to undetectable levels following infection, the plasma viral RNA levels at both peak and steady state or set point in experimental animals provide a measure of vaccine-mediated containment of virus. The medians of peak viral loads in the four groups of monkeys were $1 \times 10^8$ (control), $6 \times 10^6$ (mock Env), $4 \times 10^6$ (matched Env), and $1 \times 10^6$ (mismatched Env). Thus, the control vaccines had significantly higher peak viral loads than the vaccinated monkeys (Kruskal-Wallis test, P=0.01). However, the three groups of experimentally vaccinated monkeys did not differ significantly in their peak viral loads (P=0.28, Kruskal-Wallis test).

The group of monkeys that received SIV Gag-Pol-Nef plus mismatched Env immunogens also demonstrated better containment of virus at set point than the monkeys receiving SIV Gag-Pol-Nef plus mock Env immunogens. The log copies of plasma viral RNA on day 168 postchallenge in the groups of experimentally vaccinated monkeys were 3.70±0.52 (mean±standard error) in the mock Env-vaccinated animals, 3.61±0.35 in the matched Env-vaccinated animals, and 2.38±0.18 in the mismatched Env-vaccinated animals, with statistically significant lower plasma viral RNA levels afforded by inclusion of a mismatched Env component in the vaccine (P=0.04, Kruskal-Wallis test). A trend toward an association between total SFC responses both pre- and postchallenge and postchallenge viral load was observed. The absence of a significant difference in plasma viral RNA levels between the groups of experimentally vaccinated monkeys receiving the matched Env immunogens and those receiving the mock Env immunogens may reflect unusually low T-cell responses to the Gag immunogens in the matched Env-vaccinated animals (FIG. 20).

To analyze the mechanism mediating improved protection against CD4$^+$ T-lymphocyte loss in the Env-immunized monkeys, the antiviral humoral immune response was evaluated. Anti-Env antibody could potentially contribute to protection by neutralizing infectious virus at the time of challenge. Alternatively, a rapidly evolving anamnestic neutralizing antibody response after infection could contribute to the control of viral spread. None of the vaccinated monkeys had detectable plasma neutralizing antibodies at the time of challenge, indicating that vaccine-elicited preexisting neutralizing antibody did not contribute to viral containment. The evolution of an antibody response that neutralized the challenge virus SHIV-89.6P was monitored on a weekly basis in vaccinated monkeys after viral challenge (FIG. 23). At 3 weeks postchallenge, three animals in the matched Env group, but none in the mock or mismatched Env groups, showed an anamnestic response to the challenge virus. However, there was no statistically significant difference between the three groups of experimentally vaccinated monkeys in time to the detection of neutralizing antibody or number of animals developing detectable neutralizing antibody responses. Of note, the statistical tests applied to these data have very little power to detect differences among groups because of the small number of monkeys in each experimental group. Thus, it remains possible that neutralizing antibodies had an effect that we were unable to detect.

To evaluate further whether the emergence of a neutralizing antibody response was associated with either clinical or virologic events following SHIV-89.6P challenge, a linear regression analysis was performed to evaluate the association of detectable neutralizing antibodies with either plasma viral RNA levels or peripheral blood CD4$^+$ T-lymphocyte counts. In fact, these variables showed no significant association with the development of neutralizing antibody, whether assessed on the basis of its emergence over time or its detection at a single time during the first 6 weeks following challenge. Therefore, we were unable to demonstrate that neutralizing antibodies directed against SHIV-89.6P contributed to viral containment after challenge. Finally, the fact that the mismatched Env group appeared to control plasma viremia more effectively than the matched Env group further suggests that neutralizing antibodies did not substantially contribute to viral containment.

To examine the possible contribution of Env-specific T-cell responses to protective immunity in these monkeys, PBMC cellular immune responses from the four groups of experimental monkeys were assessed 1 week following rADV boosting for cellular immunity to a pool of HIV-1 89.6P Env peptides in an ELISPOT assay (FIG. 24, top panel). The mean responses were 449±122 SFC (mean±standard error) in the matched Env group, 730±306 SFC in the mismatched Env group, and 13±8 SFC in the mock Env group. The apparent higher PBMC SFC response in the HXB2/Bal Env-vaccinated monkeys to 89.6P Env than to HXB2/BaL Env does not achieve statistical significance. Thus, impressive cellular immunity was seen in PBMCs of the HXB2/Bal Env-immunized monkeys that reacted with the Env of the challenge virus.

Since cellular immune responses that develop following initial infection contribute to containment of AIDS virus spread (Barouch, D. H. et al. 2000 *Science* 290:486-492), we reasoned that differences in these responses to Env between the groups of vaccinated monkeys may explain the differences in their clinical outcomes. Therefore, we assessed HIV-1 89.6P Env-specific T-cell responses in these monkeys 3 and 10 weeks following SHIV-89.6P challenge (FIG. 24). Strikingly, PBMCs of the monkeys that received either matched or mismatched Env immunogens developed dramatically higher ELISPOT responses to these Env peptides than did the monkeys that received the mock Env immunizations (P=0.002, Wilcoxon rank sum test). Therefore, a strong association was seen between the generation of Env-specific T-cell responses postchallenge and the inclusion of either matched or mismatched Env immunogens in the vaccine regimens of these monkeys.

Discussion

This study demonstrates that HIV Env contributes to immune protection in a simian lentivirus challenge model. Importantly, protection was observed when the Env immunogen was matched or mismatched relative to the challenge viral strain. These findings indicate that it is advisable to include this gene product in vaccine candidates, even if such vaccines do not elicit a broadly neutralizing antibody response.

The present study provides a strong rationale for including Env antigens in HIV vaccines that advance into human efficacy trials. The current focus of effort on Env immunogen design continues to center on modifications that will induce broadly neutralizing antibodies (Mascola, J. R. 2003 Curr Mol Med 3:209-216). Such modifications will no doubt further enhance vaccine efficacy if successful. However, this study indicates that the inclusion of Env as a vaccine immunogen, even if it does not induce a broadly neutralizing antibody response, contributes to virus containment and immune preservation. The enhanced breadth of cellular immunity appears sufficient to improve the clinical protection conferred by vaccination.

Part V

Multiclade HIV-1 Envelope Immunogens Elicit Broad Cellular and Humoral Immunity in Rhesus Monkeys Abstract The development of an HIV-1 vaccine that elicits potent cellular and humoral immune responses that recognize divergent strains of HIV-1 will be critical for combating the global AIDS epidemic. The present studies were initiated to examine the magnitude and breadth of envelope (Env)-specific T lymphocyte and antibody responses generated by vaccines containing either a single or multiple genetically distant HIV-1 Env immunogens. Rhesus monkeys were immunized with DNA prime/rAd boost vaccines encoding a Gag/Pol/Nef polyprotein in combination with either a single Env or with a mixture of clade A, clade B, and clade C Envs. Monkeys receiving the multiclade Env immunization developed robust immune responses to all vaccine antigens, and importantly, a greater breadth of Env recognition than monkeys immunized with vaccines including a single Env immunogen. All groups of vaccinated monkeys demonstrated equivalent immune protection following challenge with the pathogenic simian human immunodeficiency virus (SHIV)-89.6P. These data indicate that a multicomponent vaccine encoding Env proteins from multiple clades of HIV-1 can generate broad Env-specific T lymphocyte and antibody responses without antigenic interference. This study demonstrates generating protective immune responses by vaccination with genetically diverse isolates of HIV-1.

Introduction

The extreme genetic diversity of human immunodeficiency virus type 1 (HIV-1) envelope (Env) poses a daunting challenge for the creation of an effective AIDS vaccine (Letvin, N. L et al. 2002 Annu Rev Immunol 20:73-99). While Env is the principal target for HIV-1-specific antibody responses, it also serves as a potent T cell immunogen (See PART IV). An ideal HIV-1 vaccine should elicit potent cellular and humoral immunity capable of recognizing a diversity of viral isolates (Mascola, J. R., and G. J. Nabel. 2001 Curr Opin Immunol 13:489-95; Nabel, G. J. 2001 Nature 410:1002-7). However, the extraordinary genetic variation of HIV-1 Env worldwide may make it impossible to create an effective vaccine using only a single Env gene product.

While many of the promising AIDS vaccine candidates currently under investigation in nonhuman primates and early phase human clinical trials utilize Env immunogens derived from a single HIV-1 primary isolate (Graham, B. S. 2002 Annu Rev Med 53:207-21), this approach has significant limitations. Although these vaccines generate potent cellular and humoral immune responses against HIV-1 Env, it is likely that the breadth of immunity elicited by a single Env immunogen will not effectively confer protection against divergent strains of HIV-1. It is, however, not feasible to undertake the development of multiple country- or clade-specific vaccines. Moreover, such region-specific vaccines would likely not protect against unrelated strains that might be newly introduced into a population.

One strategy for creating a single HIV-1 vaccine for worldwide use is to employ representative immunogens from multiple clades of HIV-1 in a single vaccine formulation (Nabel, G. J. et al. 2002 Science 296:2335). Such a multiclade vaccine would contain Env immunogens relevant to the majority of HIV-1 infections worldwide and could be feasibly tested. However, it is not clear whether a multicomponent vaccine encoding antigens from various clades of HIV-1 would elicit antiviral immunity greater than or equal to a vaccine employing a single Env immunogen, and whether a complex mixture of immunogens would result in antigenic-interference and diminished immune protection (Kjerrstrom, A. et al. 2001 Virology 284:46-61).

The present studies utilized the simian human immunodeficiency virus (SHIV)/rhesus monkey model to investigate the breadth and magnitude of immunity elicited by a DNA prime/ recombinant adenovirus boost vaccine containing Gag/Pol/ Nef and either single clade or multiple clade Env immunogens. Our findings demonstrate that a multiclade Env vaccine elicits potent cellular and humoral immune responses with greater breadth than can be generated with immunizations performed with a single Env immunogen.

Materials and Methods

Immunizations and challenge of rhesus monkeys. Thirty adult Indian-origin rhesus monkeys (Macaca mulatta) were maintained in a facility accredited by the Association for the Assessment and Accreditation of Laboratory Animal Care in accordance with the guidelines of the Institutional Animal Care and Use Committee for Harvard Medical School and the Guide for the Care and Use of Laboratory Animals. Monkeys were divided into five groups of six animals. Each experimental group included two monkeys expressing the MHC class I allele Mamu-A*01.

Plasmid DNA and recombinant adenovirus (rAd) vaccine vectors were constructed as previously described (see PARTS II and IV), and administered by intramuscular injection using a needle-free Biojector system and a no. 3 syringe (Bioject, Portland, Oreg.) as outlined in Table 3. Each plasmid DNA or rAd vaccine vector was split into two aliquots of 0.5 ml each, and delivered into each quadriceps muscle. Control monkeys were similarly immunized with sham DNA and sham rAd vectors. At week 42, all monkeys received an intravenous challenge with 50 50% monkey infective doses ($MID_{50}$) of SHIV-89.6P.

IFN-γ ELISPOT assays. IFN-γ ELISPOT assays were performed as described above in PART IV. Freshly isolated PBL were plated in triplicate at $2 \times 10^5$ cells/well in 100 μl final volume with either medium alone or peptide pools. Peptide pools covered the entire SIVmac239 Gag, Nef, and Pol proteins, and the HIV-1 clade A, clade B, clade C, and 89.6P Env proteins. Each pool was comprised of 15 amino acid peptides overlapping by 11 amino acids, but for the HIV-1 89.6P Env pool, which was comprised of 20 amino acid peptides overlapping by 10 amino acids. Pol and Env peptides were each split into two separate pools such that each pool contained no more than 130 peptides. Each peptide in a pool was present at a concentration of 1 μg/ml. The mean number of spots from triplicate wells was calculated for each animal and adjusted to represent the mean number of spots per $10^6$ PBL. Data are presented as the mean number of antigen-specific spots per $10^6$ PBL from 6 monkeys per group.

HIV-1 Envelope Antibody ELISA. Vaccine Research Center (VRC) plasmids 5304, 2801, and 5308 (which encode HIV-1 gp145 clade A, clade B, and clade C Env, respectively) (described in WO 02/32943) were expressed in 293 cells and purified for the major protein product. Optimized concentrations of the recombinant antigens (37.5 ng/well) were coated onto Immunol-2 HB microtiter plates (Thermo Labsystems, Milford, Mass.) overnight at 4° C. Serial dilutions of monkey plasma were done in duplicate wells and incubated for 2 hours at 37° C. Biotin labeled anti-monkey IgG/IgA/IgM (Rockland Immunochemicals, Gilbertsville, Pa.) was added for 1 hr at 37° C. Streptavidin-HRPO (KPL, Gaithurburg, Md.) was added to wells for 30 minutes at room temperature, followed by TMB substrate (KPL) for 30 minutes at room temperature. Endpoint titers for each animal were established as the last dilution with a pre-immunization corrected OD>0.2. Data are presented as the geometric mean titer from 6 monkeys per group +/−SEM.

Virus isolates and neutralization assays. A total of 30 HIV-1 isolates were studied: 11 clade B, 11 clade C and 8 clade A. Viruses were obtained from the NIH AIDS Research and Reference Reagent Program, Division of AIDS, NIAID, NIH, except as specifically noted below. All clade B viruses were primary isolates except the T-cell line adapted HxB2, which is the molecular clone of HIV-IIIB. BR07 was provided by Dana Gabuzda of the Dana-Farber Cancer Institute. It is a chimeric infectious molecular clone of NL4-3 that contains a near full-length Env gene that was cloned directly from brain tissue of an AIDS patient (Ohagen, A. et al. 2003 *J Virol* 77:12336-45). Clade B primary isolate 6101, previously called P15 (Bures, R. et al. 2000 *AIDS Res Hum Retroviruses* 16:2019-35) and clade C viruses DU123, DU151, S007 and S080 were provided by David Montefiori (Duke University Medical Center). The clade C viruses were obtained from HIV-1 infected patients in South Africa (Du prefix) or Malawi (S prefix) and have been previously described (Bures, R. et al. 2002 *J Virol* 76:2233-44). TV1 (clade C) was provided by David Montefiori and Estrelita Janse Van Rensburg (University of Stellenbosch, South Africa). GS14 is an infectious molecular clone of an Ethiopian clade C virus that was provide by Francine McCutchan and colleagues from the US Military HIV Research program. Clade A viruses DJ263 and 44951 were primary virus isolates provided by researchers from the US Military HIV Research program. The UG29 isolate had been previously passaged into H9 cells, and would therefore be considered a T-cell line adapted virus.

Virus neutralization assays were performed using a single round of infection flow cytometric assay using previously described methods (Mascola, J. R. et al. 2002 *J Virol* 76:4810-21). This assay detects HIV-1 infected T-cells by intracellular staining for HIV-1 p24 Gag antigen (p24-Ag). A protease inhibitor is used to prevent secondary rounds of virus replication. The percent virus neutralization mediated by each immune plasma was derived by calculating the reduction in the number of p24-Ag positive cells in the test wells with immune sera, compared to the number of p24-Ag positive cells in wells containing pre-immune plasma from the corresponding animal. Plasma from the six sham immunized monkeys was included for analysis, and these data are shown in the results section. All plasma samples were also tested against an amphotropic murine leukemia virus (MuLV) to test for non-HIV-1 specific plasma effects. The MuLV reporter viruses encoded green fluorescent protein (GFP) and infected T-cell cells were detected by expression of GFP rather than expression of p24-Ag (Mascola, J. R. et al. 2002 *J Virol* 76:4810-21).

Quantitation of plasma viral RNA levels and $CD4^+$ T lymphocyte counts. Plasma viral RNA levels were measured by an ultrasensitive branched DNA amplification assay with a lower detection limit of 125 copies per ml (Bayer Diagnostics, Berkeley, Calif.). Peak plasma viral load was measured on day 16 post-SHIV-89.6P challenge in all vaccinated and control monkeys. Set point plasma viral RNA levels were calculated as the median of values measured at six time points between days 85 and 169 post-challenge. The percentage of $CD4^+$ T lymphocytes in the peripheral blood of infected monkeys was determined by monoclonal antibody staining and flow cytometric analysis. Briefly, freshly isolated PBL were stained with anti-CD3 APC (FN18), anti-CD4 PE (19Thy5D7), and anti-CD8 FITC (SK1, BD Biosciences, Mountain View, Calif.). Samples were acquired using a FACSCalibur flow cytometer and data analyzed using CellQuest software (BD Biosciences).

Statistical Analysis. The nonparametric Wilcoxon rank sum test was used to compare $CD4^+$ T lymphocytes, peak viral RNA, and set point viral RNA between monkeys in the non-vaccinated and vaccinated groups. All tests were two-sided.

Results

Study design. Thirty adult rhesus monkeys were divided into five experimental groups of six animals (Table 3). Groups 1-4 received three priming immunizations at weeks 0, 4, and 8 with 4.5 mg plasmid DNA vectors expressing an SIVmac239 Gag-Pol-Nef fusion protein and plasmid DNA vectors expressing various HIV-1 Env proteins. Groups 1-3 were immunized with single HIV-1 Env immunogens as follows: 1) 4.5 mg clade B Env (high clade B), 2) 1.5 mg clade B Env (low clade B), and 3) 4.5 mg clade C Env (high clade C). Group 4 monkeys were immunized with a combination of HIV-1 Env immunogens, 1.5 mg each of a clade A Env, clade B Env, and clade C Env (clade A+B+C). At week 26, monkeys received a single rAd boost immunization ($2.0 \times 10^{12}$ total particles) with vectors expressing SIVmac239 Gag-Pol and various HIV-1 Env genes consistent with those delivered during the DNA priming (Table 3). Groups 1-3 received: 1) $1.0 \times 10^{12}$ particles clade B Env (high clade B), 2) $3.3 \times 10^{11}$ particles clade B Env (low clade B), 3) $1.0 \times 10^{12}$ particles clade C Env (high clade C). Group 4 received $3.3 \times 10^{11}$ particles each of clade A, clade B and clade C Env (clade A+B+C). Group 5 monkeys were immunized with sham DNA and sham rAd vectors. DNA prime and rAd boost immunizations were delivered by intramuscular injection. All plasmid DNA and rAd vectors expressed codon-modified SIVmac239 and HIV-1 genes for enhanced expression in mammalian cells. All env genes used in these vectors were ΔCFI constructs, containing mutations in the cleavage, fusion, and interhelical domains that have previously been shown to enhance expression and immunogenicity (Chakrabarti, B. K. et al. 2002 *J Virol* 76:5357-68). The percent amino acid identity among the HIV-1 Env immunogens ranged from 71-76%, with the clade B and clade C Envs demonstrating the greatest divergence.

TABLE 3

Experimental groups and immunization schedule

| Group | SIV Gag-Pol-Nef Plasmid (mg) | HIV-1 Env Plasmid (mg) | Sham Plasmid (mg) |
|---|---|---|---|
| 1) High Clade B Env | 4.5 | 4.5 Clade B | — |
| 2) Low Clade B Env | 4.5 | 1.5 Clade B | 3.0 |
| 3) High Clade C Env | 4.5 | 4.5 Clade C | — |
| 4) Clade A + B + C Env | 4.5 | 1.5 Clade A | |
| | | 1.5 Clade B | |
| | | 1.5 Clade C | |
| 5) Control | — | — | 9.0 |

| Group | SIV Gag-Pol rAd (particles) | HIV-1 Env rAd (particles) | Sham rAd (particles) |
|---|---|---|---|
| 1) High Clade B Env | $1.0 \times 10^{12}$ | $1.0 \times 10^{12}$ Clade B | — |
| 2) Low Clade B Env | $1.0 \times 10^{12}$ | $3.3 \times 10^{11}$ Clade B | $6.6 \times 10^{11}$ |
| 3) High Clade C Env | $1.0 \times 10^{12}$ | $1.0 \times 10^{12}$ Clade C | — |
| 4) Clade A + B + C Env | $1.0 \times 10^{12}$ | $3.3 \times 10^{11}$ Clade A | |
| | | $3.3 \times 10^{11}$ Clade B | |
| | | $3.3 \times 10^{11}$ Clade C | |
| 5) Control | — | — | $2.0 \times 10^{12}$ |

Figure 25A:
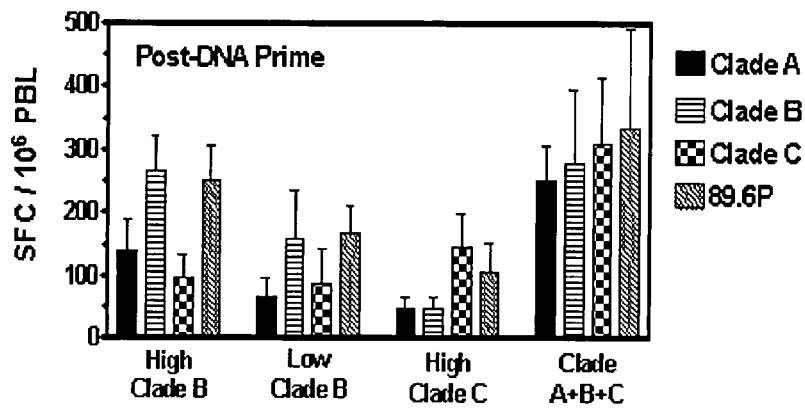

Cellular immune responses elicited by immunization. The cellular immune responses to SIV Gag and Pol and HIV-1 Envs in immunized monkeys were assessed by pooled peptide IFN-γ ELISPOT assays using freshly isolated PBL. Moreover, the extent of cross-clade reactivity of vaccine-elicited Env-specific cellular immune responses was determined by measuring PBL IFN-γ ELISPOT responses to clade A, clade B, and clade C Env peptide pools. Because these monkeys were to be challenged with SHIV-89.6P, we also evaluated T cell recognition of a peptide pool representing the clade B 89.6P Env. Monkeys receiving the high and low dose clade B Env plasmid DNA immunogen generated cellular immune responses to all Env peptide pools tested (FIG. 25A). The responses to both the clade B and 89.6P (heterologous clade B) Env peptide pools were of a higher frequency than those observed against the clade A or clade C Env pools. Monkeys receiving the high dose clade C Env immunogen also developed cellular immune responses to all Env peptide pools tested, but with clade C Env responses higher than those to clade A, clade B, or 89.6P Envs. Importantly, comparable cellular immune responses to clade A, B, C and 89.6P HIV-1 Env peptide pools were observed in PBL of the monkeys receiving the multiclade plasmid DNA immunogens.

Figure 25B:
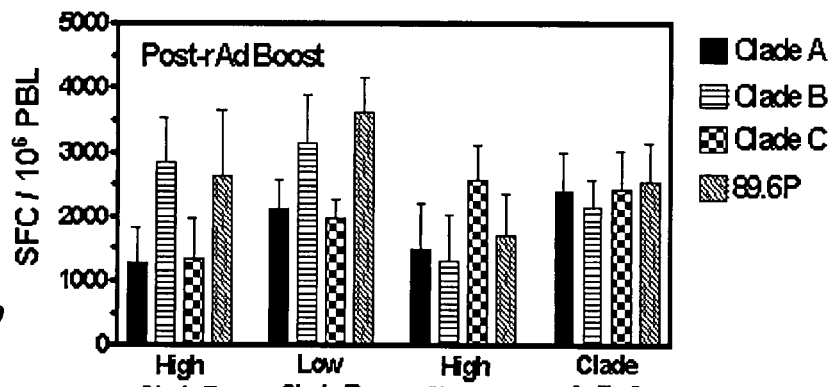
Figure 25C:
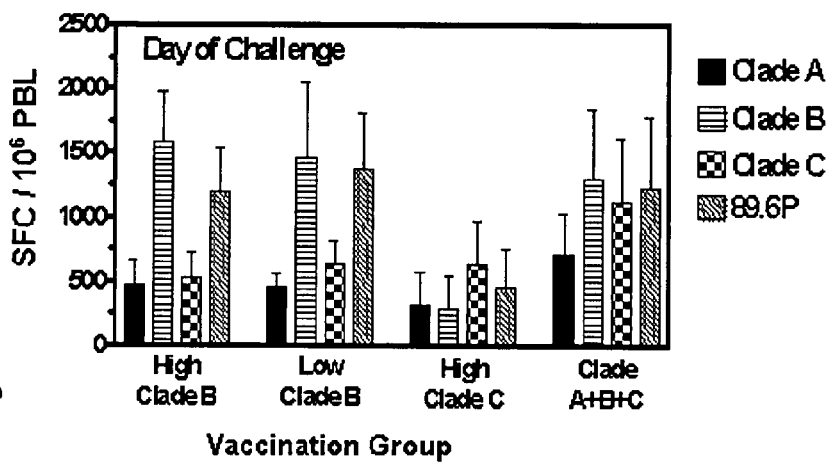

The DNA primed cellular immune responses of all vaccinated monkeys were dramatically augmented following the boost immunization with the rAd vaccines (FIG. 25B). While responses to all Env peptide pools were observed in the monkeys receiving the high dose clade B Env rAd boost immunization, SFC responses to clade B and 89.6P peptides were higher than those to clade A or C peptides (p=0.06 and 0.04, respectively, Wilcoxon rank sum test). The Env-specific cellular immune responses of the low dose clade B Env-immunized monkeys were comparable to those of monkeys receiving the high dose clade B Env immunogens. Thus, lowering the dose of the Env plasmid and rAd vaccines by two thirds did not result in major reductions in immunogenicity. The animals boosted with the high dose clade C Env rAd construct also showed an increase in T cell reactivity to all Env peptide series, but responses to clade C peptides were significantly higher than those to clade A or B peptides (p=0.04 for both). In contrast, multiclade Env immunized monkeys exhibited no bias in Env-specific cellular immune responses. Following the boost immunization with the clade A, clade B, and clade C Env rAd constructs, the monkeys developed responses to the clade A, clade B, clade C, and 89.6P Env peptide pools that were of comparable magnitude (FIG. 25B). Furthermore, the magnitudes of each individual clade-specific ELISPOT response in these monkeys were comparable to the optimal clade-specific response elicited in monkeys receiving a single clade Env immunogen. Finally, the vaccine-elicited Env-specific T cell responses in all groups of monkeys were durable, persisting at a high frequency up to the time of viral challenge (FIG. 25C).

Cellular immune responses to SIV Gag and Pol were observed in all vaccinated monkeys following the DNA priming immunizations as well as following the rAd boost immunizations (FIG. 26). Importantly, PBL of monkeys receiving the multiclade Env immunizations developed ELISPOT responses to these SIV proteins that were comparable in magnitude to those observed from monkeys receiving single clade Env immunogens. Thus, immunizing monkeys with the complex pool of SIV Gag-Pol and multiclade HIV-1 Env immunogens elicited cellular immune responses to all the vaccine components without evidence of antigenic interference.

Antibody responses elicited by immunization. The magnitude and breadth of humoral immune responses elicited by single clade and multiclade Env immunizations were investigated in these monkeys following rAd administration. Plasma samples were tested for antibody binding activity to the clade A, clade B, and clade C gp145 Env proteins by ELISA. Monkeys receiving the high dose clade B Env immunogens generated antibody responses that bound all three Env proteins (FIG. 27); however, the highest antibody titers were against the clade B Env protein (p=0.002 and 0.13 versus clade A and C Env proteins, respectively, Wilcoxon rank sum test). A similar pattern of antibody reactivity was observed in the monkeys receiving the low dose clade B Env immunizations, and lowering the dose of Env immunogen by two thirds did not result in a substantial reduction in immunogenicity. Monkeys receiving the high dose clade C Env immunogens similarly developed antibody responses that recognized all three Env antigens, but titers against the clade C Env protein were significantly higher than those against clade A or B Env proteins (p=0.004 and 0.002, respectively). In contrast, monkeys immunized with the mixture of clade A, clade B, and clade C Env immunogens demonstrated comparable antibody responses to all three Env proteins.

Plasma samples obtained following the rAd boost immunizations were also tested for neutralizing activity against panels of 30 clade A, clade B, and clade C HIV-1 isolates (FIG. 28). While plasmas from all groups of vaccinated monkeys demonstrated modest levels of neutralization against some HIV-1 isolates, the antibodies of monkeys immunized with a single clade Env immunogen exhibited the highest neutralizing activity against viruses of the same clade. Thus, plasma from the clade B immunized animals displayed little activity against clade A or C viruses and plasmas from clade C immunized animals did not neutralize clade B viruses. However, there was some cross-neutralization of clade A viruses by the clade C vaccine plasma. Importantly, the multiclade Env immunized monkeys developed antibodies with neutralizing activity against some HIV-1 strains from all three clades, and there was no decrement in the potency of neutralization compared to single Env immunization. Two controls were performed to demonstrate that the modest levels of virus neutralization observed were due to HIV-1 specific antibodies. The mean neutralization activity of plasma obtained from sham vaccinated monkeys was consistently less than twenty percent (FIG. 28, dashed line). In addition, the mean activity of plasma from each of the vaccine groups against a MuLV Env pseudovirus was less than 20% (shown in FIG. 28A). These data indicate that the multiclade Env immunization regimen elicited humoral immune responses of increased breadth when compared to responses elicited by immunization with a single Env, and without evidence of antigenic interference.

Protection against SHIV-89.6P challenge. All monkeys received an intravenous challenge with 50 $MID_{50}$ SHIV-89.6P on week 42, 16 weeks following the rAd boost immunization. At two weeks after viral challenge, robust cellular immune responses to HIV-1 Env and SIV Gag and Pol were detected in all groups of experimentally vaccinated monkeys but not in control monkeys (FIG. 29). Peak plasma viral RNA levels were observed in all monkeys on day 16 following challenge, with median $\log_{10}$ values of 7.54 (control), 5.66 (high clade B Env), 6.83 (low clade B Env), 6.20 (high clade C Env), and 6.46 (clade A+B+C Env) copies of viral RNA detected (FIG. 30A). Thus, a significant reduction in the peak viral load following SHIV-89.6P challenge was observed in all groups of experimentally vaccinated monkeys when compared with non-vaccinated control monkeys (p values ranging from 0.002 to 0.004, Wilcoxon rank sum test). However, no significant differences were observed in peak viral RNA levels when monkeys receiving the single clade Env or multiclade Env immunizations were compared.

All groups of experimentally vaccinated monkeys also demonstrated better long term containment of virus than control monkeys, with median $\log_{10}$ set point viral RNA levels of 4.77 (control), 2.30 (high dose clade B Env), 2.63 (low dose clade B Env), 2.28 (high dose clade C Env), and 2.69 (clade A+B+C Env) copies of viral RNA measured between days 85 and 169 post-challenge (FIG. 30B). No significant differences in set point viral loads were observed among the groups of monkeys vaccinated with the single or multiclade Env immunogens.

Peripheral blood $CD4^+$ T lymphocyte counts were also measured in the infected monkeys as a means of evaluating vaccine-mediated protection against SHIV-89.6P-induced disease. Sham vaccinated control monkeys developed a rapid and persistent decline in $CD4^+$ T lymphocytes within the first 21 days following challenge (FIG. 31). All groups of experimentally vaccinated monkeys exhibited significant blunting of $CD4^+$ T lymphocyte loss between days 85 and 169 post-challenge when compared with control monkeys (p values ranging from 0.015 to 0.026). While there were no significant differences in $CD4^+$ T lymphocyte numbers between the groups of vaccinated monkeys during the acute and chronic phases of infection, monkeys in the high dose clade B Env and multiclade Env vaccine groups demonstrated the best preservation of this lymphocyte population.

Discussion

A global HIV-1 vaccine must elicit effective immune responses to diverse viral isolates. In fact, broadly cross-reactive HIV-1-specific T cell immune responses have been described. HIV-1-infected individuals develop T lymphocyte responses that recognize viral sequences from a diversity of HIV-1 clades (Cao, H. et al 1997 *J Virol* 71:8615-23). Cross-clade reactive CTL have also been detected in uninfected volunteers who have been vaccinated with recombinant canarypox constructs (Ferrari, G. et al. 2000 *AIDS Res Hum Retroviruses* 16:1433-43). However, because these studies employed CTL clones or in vitro cultured PBL to assess cross-clade T cell reactivity, the true breadth of these HIV-1-specific immune responses is unknown. In the present study we demonstrate that immunization of rhesus monkeys with a DNA prime/rAd boost vaccine that includes multiple Env immunogens elicits cellular and humoral immune responses that exhibit a greater breadth of Env-specific recognition than those observed in monkeys immunized with single Env immunogens.

PBL from monkeys immunized with single HIV-1 Env immunogens demonstrated high frequency cellular immune responses to peptide pools matching the vaccine-encoded Env immunogen, with lower frequency responses to peptides of Env proteins not included in the vaccine. These cross-reactive responses may reflect T lymphocyte recognition of conserved viral epitopes, as well as cross-reactive recognition of variant epitopes that may differ by limited numbers of amino acids (Charini, W. A. et al. 2001 *J Immunol* 167:4996-5003; Keating, S. M. et al. 2002 *AIDS Res Hum Retroviruses* 18:1067-79). The highest degree of heterologous Env recognition in this study was the reactivity of PBL of monkeys immunized with the clade B HXBc2/BaL Env immunogen against peptide pools representing 89.6P Env, a heterologous clade B Env (FIG. 25). HXBc2/BaL Env shares 81% amino acid identity with 89.6P Env, and only 75% and 72% identity, respectively, with the clade A and C Env sequences used in these immunizations. These data indicate that immunizing with single Env immunogens may elicit the highest frequency cross-reactive T cell responses against Envs of viruses of the same clade.

A concern with a vaccine that includes viral proteins from multiple clades of HIV-1 is that interference between these diverse antigens may diminish immune responses. In fact, such antigenic interference has been observed in vaccines that include proteins of multiple pathogens (Fattom, A et al. 1999 *Vaccine* 17:126-33; Insel, R. A. 1995 *Ann N Y Acad Sci* 754:35-47). Moreover, studies have shown that complex mixtures of plasmid DNA vaccines can lead to decreased protein expression and immunogenicity in vivo (Kjerrstrom, A. et al. 2001 *Virology* 284:46-61; Sedegah, M. et al. 2004 *Gene Ther* 11:448-56). The findings in the present study, however, demonstrate that including Env immunogens from multiple clades of HIV-1 in a single vaccine can increase the breadth of vaccine-elicited Env-specific T cell and antibody responses. Thus, monkeys immunized with the multiclade Env vaccine developed high frequency cellular immune responses and high titer antibody responses to all vaccine-encoded Env antigens. The magnitudes of T lymphocyte responses to the clade B and clade C Env peptide pools following the DNA prime and rAd boost with the multiclade Env immunogens were similar to those observed in monkeys receiving the high dose single clade B or C Env vaccines. Furthermore, no deleterious effects on the magnitude of Gag- or Pol-specific cellular immune responses were detected in the multiclade Env immunized monkeys. These results support studies in mice demonstrating that multiclade HIV-1 vaccines can elicit robust cellular and humoral immune responses to all vaccine-encoded antigens without evidence of antigenic-interference (PARTS I and II).

It is encouraging to note that the inclusion of clade A, B, C Env immunogens elicits neutralizing antibodies to some clade strains not included in the vaccine. The present data further show that multiclade Env immunization does not diminish vaccine-elicited immune protection against SHIV-89.6P infection. Monkeys receiving DNA prime/rAd boost vaccines encoding either a single Env or multiple clade Env immunogens demonstrated equivalent viral containment during acute and chronic infection, and comparable preservation of CD4+ T lymphocytes. We have demonstrated above (see PART V) that DNA prime/rAd boost vaccine-elicited protection against SHIV-89.6P infection is associated with an anamnestic antigen-specific cellular rather than neutralizing antibody responses. It therefore is not surprising that no significant differences in clinical protection were evident between the various groups of vaccinated monkeys, as they all demonstrated robust pre-challenge cellular immune responses to SIV Gag and Pol, as well as some degree of cellular immune cross-reactivity to 89.6P Env. In fact, the ELISPOT responses to 89.6P Env increased rapidly in PBL of all groups of Env-vaccinated monkeys following challenge, suggesting that vaccine-elicited T lymphocytes capable of recognizing 89.6P Env epitopes expanded in response to the replicating virus (FIG. 29).

The present study demonstrates that the inclusion of viral proteins from multiple clades of HIV-1 is a viable approach for a global HIV-1 vaccine.

Part VI

VRC-HIVDNA-009-00-VP

Introduction

VRC-HIVDNA-009-00-VP is a vaccine composed of four DNA plasmids encoding proteins from HIV-1 and is intended to prevent HIV-1 infection. The vaccine has been designed to elicit immune responses against several proteins from three HIV-1 clades. Plasmid VRC-4306 (SEQ ID NO: 20) is designed to express HIV-1 polyproteins (structural core protein Gag, viral polymerase Pol, and accessory protein Nef) from clade B and is 50% (by weight) of the vaccine. Plasmids VRC-5305 (SEQ ID NO: 21), VRC-2805 (SEQ ID NO: 22), and VRC-5309 (SEQ ID NO: 23) express the HIV-1 Envelope (Env) glycoproteins from clade A, clade B, and clade C, respectively, and are each 16.67% (by weight) of the vaccine.

The DNA plasmid expressing HIV-1 Gag-Pol-Nef polyprotein has been modified to reduce toxicity through the incorporation of deletions into the regions affecting the protease, reverse transcriptase, and integrase activities. The amino acid sequence of the Nef protein was not modified. The amino acid sequence of the Nef protein was fused in frame from the initiator methionine to the pol gene of HIV and is non-functional. The sequences used to create the DNA plasmids encoding Env are derived from three HIV-1 CCR5-tropic strains of virus. Expression of the gene products is controlled by the constitutive cytomegalovirus (CMV) promoter. These DNA plasmids have been produced in bacterial cell cultures under kanamycin selection. In all cases, bacterial cell growth is dependent upon expression of the kanamycin resistance protein encoded in the plasmid DNA. Following growth of bacterial cells harboring the plasmid, the plasmid DNA is purified from cellular components. The clade B gag-pol-nef plasmid (VRC-4306) is 9790 nucleotide pairs in length and has an approximate molecular weight of 6.5 MDa; the clade A, B, and C env plasmids (VRC-5305, VRC-2805, and VRC-5309) are 6836, 6869, and 6829 nucleotides in length, respectively, and have an approximate molecular weight of 4.5 MDa.

| Description of the Drug Substance | | |
|---|---|---|
| 1. | Name of the Drug Substance:<br>Description:<br>Molecular Weight:<br>Nucleotide Base Pairs: | VRC-2805 (SEQ ID NO: 22)<br>Env glycoprotein, clade B<br>4.5 MDa<br>6869 |
| 2. | Name of Drug Substance:<br>Description:<br>Molecular Weight:<br>Nucleotide Base Pairs: | VRC-4306 (SEQ ID NO: 20)<br>Gag-Pol-Nef, clade B<br>6.5 MDa<br>9790 |
| 3. | Name of Drug Substance<br>Description:<br>Molecular Weight:<br>Nucleotide base pairs | VRC-5305 (SEQ ID NO: 21)<br>Env glycoprotein, clade A<br>4.5 MDa<br>6836 |
| 4. | Name of Drug Substance<br>Description:<br>Molecular Weight:<br>Nucleotide base pairs: | VRC-5309 (SEQ ID NO: 23)<br>Env glycoprotein, clade C<br>4.5 MDa<br>6829 |

A. Production of the Gag-Pol-Nef DNA Plasmids

VRC-4306 [pVR1012 Gag-B (ΔFS) Pol (ΔPR ΔRT ΔIN) Nef/h]

To construct DNA plasmid VRC-4306, diagrammed in FIG. 32, the protein sequences of the Gag, Pol, and Nef proteins from an HIV-1 clade B were used to create a synthetic polyprotein version of the gag-pol-nef genes using codons optimized for expression in human cells. The synthetic gag gene is from HIV-1 clade B strain HXB2 (GenBank accession number K03455, amino acids 1-432), the synthetic pol gene (pol/h) is from HIV-1 clade B NL4-3 (GenBank accession number M19921), and the synthetic nef gene (nef/h) is from HIV-1 clade B strain PV22 (GenBank accession number K02083). The nucleotide sequence of the synthetic gag-pol-nef/h gene shows little homology to the HIV-1 gene, but the protein encoded is the same.

In addition, mutations created in the regions that affect protease (R113G), reverse transcriptase (D341H), and integrase (D779A) reduce the potential for functional activity. Note that GenBank accession number M19921 has a G at position 113, but mutagenesis studies of pol genes have shown an G at this position shows no functional activity (Loeb, D. D. et al. 1989 *Nature* 340:397-400). The first two amino acids of Pol were deleted in order to make the gag-pol-nef fusion gene. No modifications were made to the gag and nef genes.

Plasmid VRC-4306 was constructed by fusion of nef/h to the 3' terminal of the gag-pol plasmid (VRC-4302), which is described in the WO 02/32943. There were no losses or additions of amino acids created by the fusion between pol and nef. The ATG of nef was preserved. The construct was then inserted into the pVR1012 backbone using SalI and BbvCI restriction sites. The SalI (5 nt upstream from ATG) to BbvCI (4917 nt downstream from ATG) fragment contains the 5' end and the ATG was cloned into the SalI to BbvCI sites of the pVR1012 backbone.

A summary of the predicted VRC-4306 domains is provided in Table 4. The plasmid is 9790 nucleotide pairs (np) in length and has an approximate molecular weight of 6.5 MDa. The kanamycin gene is incorporated into the bacterial vector backbone as a selectable marker. The sequence of VRC-4306 is provided as SEQ ID NO: 20.

TABLE 4

Summary of Predicted Domains of VRC-4306 Clade B gag (Δfs) pol ΔPR, RT, INT Nef/h

| Fragment Name or Protein Domain | Fragment Size (bp) | Predicted Fragment Location |
|---|---|---|
| pUC derived | 247 | 1-247 |
| CMV-IE enhancer/promoter | 638 | 248-885 |
| CMV-IE 5' UT region | 244 | 886-1129 |
| CMV IE intron | 711 | 1130-1840 |
| Synthetic linker | 39 | 1841-1879 |
| Gag (Δ fs) Pol (Δ PR, RT, INT) Nef/h | 4920 | 1880-6799 |
| Synthetic linker | 8 | 6800-6807 |
| Bovine growth hormone poly A | 553 | 6808-7360 |
| pUC derived | 1473 | 7361-8833 |
| Kanamycin resistance gene | 623 | 8834-9456 |
| pUC derived | 334 | 9457-9790 |

B. Production of the Env DNA Plasmids

These DNA plasmids are designed to express HIV-1 Env glycoproteins that are modified to reduce potential cellular toxicity by deletion of the fusion domain, the cleavage domains, and a portion of the interspace (IS) between heptad 1 (H1) and heptad 2 (H2).

a. VRC-5305 [pVR1012x/s CCR5-tropic gp145 Clade A (ΔCFI)/h]

The DNA plasmid, VRC-5305, is diagrammed in FIG. 33. The protein sequence of the clade A Env polyprotein (gp160) from 92rw020 (CCR5-tropic, GenBank accession number U08794) was used to create a synthetic version of the gene (clade A gp145ΔCFI/h) using codons modified for expression in human cells. The nucleotide sequence of the clade A CCR5-tropic gp145ΔCFI shows little homology to the 92rw020 gene, but the protein encoded is the same (note that GenBank U08794 sequence does contain the MR codons at the start of the sequence, so these were inserted into the synthetic construct).

The truncated Env polyprotein contains the entire surface (SU) and transmembrane (TM) proteins, but lacks the fusion and cytoplasmic domains. Regions important for oligomer formation are retained, specifically the two helical coiled coil regions. The fusion and cleavage (F/CL) domains from amino acids 486-519 were deleted. The IS between H1 and H2 from amino acids 576-603 was also deleted. The construct was then inserted into the pVR1012x/s backbone using XbaI and BamH1 restriction sites. The XbaI (17 nt upstream from ATG) to BamHI (1897 nt downstream from ATG) fragment contains a polylinker at the 5' end and the ATG was cloned into the XbaI to BamH1 sites of pVR1012x/s backbone.

A summary of the predicted VRC-5305 domains is provided in Table 5. The plasmid is 6836 nucleotide pairs (np) in length and has an approximate molecular weight of 4.5 MDa. The sequence of VRC-5305 is provided as SEQ ID NO: 21.

TABLE 5

Summary of Predicted Domains of VRC-5305 Clade A CCR5-tropic gp145ΔCFI/h

| Fragment Name or Protein Domain | Fragment Size (bp) | Predicted Fragment Location |
|---|---|---|
| pUC derived | 247 | 1-247 |
| CMV-IE enhancer/promoter | 638 | 248-885 |
| CMV-IE 5' UT region | 244 | 886-1129 |
| CMV IE intron | 711 | 1130-1840 |
| Synthetic linker | 82 | 1841-1922 |
| CCR5-tropic gp145 Δ CFI/h | 1881 | 1923-3803 |
| Synthetic linker | 16 | 3804-3819 |
| Bovine growth hormone poly A | 587 | 3820-4406 |
| pUC derived | 1473 | 4407-5879 |
| Kanamycin resistance gene | 623 | 5880-6502 |
| pUC derived | 334 | 6503-6836 | b. VRC-2805 [pVR1012x/s CCR5-Tropic gp145(ΔF/CL ΔH IS)/h]

The DNA plasmid, VRC-2805, is diagrammed in FIG. 34. The protein sequence of the clade B Env glycoprotein (gp160) from HXB2 (CXCR4-tropic, GenBank accession number K03455) was used to create a synthetic version of the gene (CXCR4gp160/h) using codons modified for optimal expression in human cells. The nucleotide sequence X4gp160/h shows little homology to the HXB2 gene, but the protein encoded is the same with the exception of the following amino acid substitutions: F53L, N94D, K192S, P470L, I580T, and Z653H. To produce a CCR5-tropic version of the Env glycoprotein (R5gp160/h), the region encoding HIV-1 Env polyprotein amino acids 205 to 361 from X4gp160/h (VRC-3300, described in the WO 02/32943) was replaced with the corresponding region from the BaL strain of HIV-1 (GeneBank accession number M68893), again using human preferred codons. The nucleotide sequence R5gp160/h shows little homology to the CCR5 gene, but the protein encoded is the same with the following amino acid (aa) substitutions: I219N, L265V, N266T, and S268N.

The full-length CCR5-tropic version of the env gene from pR5gp160/h (VRC-3000, described in the WO 02/32943) was terminated after the codon for amino acid 704. The truncated Env glycoprotein (gp145) contains the entire surface (SU) protein and a portion of the transmembrane (TM) protein including the fusion domain, the transmembrane domain, and regions important for oligomer formation, specifically, the two helical coiled coil motifs. The fusion and cleavage (F/CL) domains from amino acids 503-536 were deleted. The IS between H1 and H2 from amino acids 594-619 was also deleted. The construct was then inserted into the pVR1012x/s backbone using XbaI and BamHI restriction sites. The XbaI (18 nt upstream from ATG) to BamHI (1937 nt downstream from ATG) fragment that contains a polylinker at the 5' end and the ATG was cloned into the XbaI to BamH1 sites of the 1012x/s backbone.

A summary of the predicted VRC-2805 domains is provided in Table 6. The plasmid is 6869 nucleotide pairs (np) in length and has an approximate molecular weight of 4.5 MDa. The kanamycin gene is incorporated into the bacterial vector backbone as a selectable marker. The sequence of VRC-2805 is provided as SEQ ID NO: 22.

TABLE 6

Summary of Predicted Domains of Clade B VRC-2805 CCR5-tropic gp145ΔCFI/h

| Fragment Name or Protein Domain | Fragment Size (bp) | Predicted Fragment Location |
|---|---|---|
| pUC derived | 247 | 1-247 |
| CMV-IE enhancer/promoter | 638 | 248-885 |
| CMV-IE 5' UT region | 244 | 886-1129 |
| CMV IE intron | 711 | 1130-1840 |
| Synthetic linker | 74 | 1841-1914 |
| CCR5-tropic gp145 Δ CFI/h | 1929 | 1915-3843 |
| Synthetic linker | 9 | 3844-3852 |
| Bovine growth hormone poly A | 587 | 3853-4439 |
| pUC derived | 1473 | 4440-5912 |
| Kanamycin resistance gene | 623 | 5913-6535 |
| pUC derived | 334 | 6536-6869 | c. VRC-5309 [pVR1012x/s CCR5-Tropic gp145 Clade C (ΔCFI)/h]

The DNA plasmid, VRC-5309, is diagrammed in FIG. 35. The protein sequence of the clade C Env polyprotein (gp145ΔCFI) from 97ZA012 (CCR5-tropic, GenBank accession number AF286227) was used to create a synthetic version of the gene (clade C gp145ΔCFI/h) using codons modified for optimal expression in human cells. The nucleotide sequence of the clade C CCR5-tropic gp145ΔCFI/h shows little homology to the gene 97ZA012, but the protein encoded is the same except for the following substitution: D605E. The truncated Env polyprotein contains the entire SU protein and the TM domain, but lacks the fusion domain and cytoplasmic domain. Regions important for oligomer formation are retained, specifically the two helical coiled coil motifs. The fusion and cleavage (F/CL) domains from amino acids 487-520 were deleted. The interspace between H1 and H2 from amino acids 577-604 was also deleted. The construct was then inserted into the pVR1012x/s backbone using XbaI and BamH1 restriction sites. The XbaI (17 nt upstream from ATG) to BamH1 (1882 nt downstream from ATG) fragment contains a polylinker at the 5' end and the ATG was cloned into the XbaI to BamH1 sites of pVR1012x/s backbone.

A summary of the predicted VRC-5309 domains is provided in Table 7. The plasmid is 6829 nucleotide pairs (np) in length and has an approximate molecular weight of 4.5 MDa. The kanamycin gene is incorporated into the bacterial vector backbone as a selectable marker. The sequence of VRC-5309 is provided as SEQ ID NO: 23.

TABLE 7

Summary of Predicted Domains of VRC-5309 Clade C CCR5-tropic gp145ΔCFI/h

| Fragment Name or Protein Domain | Fragment Size (bp) | Predicted Fragment Location |
|---|---|---|
| pUC derived | 247 | 1-247 |
| CMV-IE enhancer/promoter | 638 | 248-885 |
| CMV-IE 5' UT region | 244 | 886-1129 |
| CMV IE intron | 711 | 1130-1840 |
| Synthetic linker | 82 | 1841-1922 |
| CCR5-tropic gp145 Δ CFI/h | 1881 | 1923-3803 |
| Synthetic linker | 9 | 3804-3812 |
| Bovine growth hormone poly A | 587 | 3813-4399 |
| pUC derived | 1473 | 4400-5872 |
| Kanamycin resistance gene | 623 | 5873-6495 |
| pUC derived | 334 | 6496-6829 |

C. Analysis of VRC-HIVDNA009-00-VP Plasmid Components Sequence Homology to the Human Genome Plasmids VRC-2805, 4306, 5305, and 5309 were sequenced by Lark Technologies and the sequences subjected to a BLAST search using the BLASTN program searching the human est database. The search was done using parameters that only identified sequence homologies with expected values (E values) of 0.01 or lower. This means that the statistical possibility of a homology occurring by chance alone is only $1/100$. Anything at this level or lower (i.e. less than $1/100$) will be picked up by the search. The results show numerous homologies at less than E=0.01. With one exception, the homologies are either in the pUC18 or the CMV promoter portions of the plasmids. In addition, the sequences detected were between 85 and 100% identical to the sequences in the plasmids. It is believed that these homologies are spurious and result from contamination of the human genome database with plasmid sequence from cloning operations.

The other result shows homology with the bovine growth hormone poly A terminator portion of the plasmid. The sequences detected were 90 to 100% identical to the sequences in the plasmids. The human genes associated with this homology were not related to human growth hormone or related proteins. Upon further inspection, the description of the clones revealed that they had been excised from expression vectors (e.g., pDNA3) in which the cloning site was immediately adjacent to a bovine growth hormone poly A terminator. As with the aforementioned pUC18 homologies, it is believed that these homologies are spurious and represent contamination of the database with plasmid sequence from cloning operations.

D. Analytical Methods for the Drug Substance

In Vitro Transfection and Expression Assay. Expression testing for the individual plasmids (gag-pol-nef, Clade A envelope, Clade B envelope and Clade C envelope) is conducted prior to formulation of the vaccine product. Semi-quantitative values of the expression levels of the individual plasmids is determined by comparing the intensity of the reactive protein bands on the Western Blot with the intensity of standards run under the same conditions. Once the plasmids are combined, expression is qualitatively verified using the same assay procedures. However, since the antibodies are cross-reactive, the level of expression of the specific clades of envelope in the mixture cannot be quantitated.

Expression of the Gag-Pol-Nef protein encoded by plasmid VRC-4306 is determined by quantitation of the level of Gag-Pol-Nef protein expressed by transfected HEK-293 (human embryonic kidney) cells. For transfection, $10^5$ to $10^6$ cells are transfected with 1-5 μg of VRC-4306 plasmid DNA using the calcium phosphate method. Cells are incubated for 14-20 hours to allow for DNA uptake. Following a medium change, cells are grown for an additional 24-48 hours before harvesting. Transfection efficiency is monitored using a human alkaline phosphatase vector in a similar backbone.

After cell lysis, 10-50 μg of total cellular protein is loaded onto an SDS-PAGE gel to separate the crude lysate proteins. For quantitation, 25-250 ng of HIV1 gag-β-gal fusion protein (Chemicon) is mixed with 10 μg of cell lysate from non-transfected HEK293 cells and loaded onto the gel. Following electrophoresis for 1-3 hours, the proteins are transferred to a nitrocellulose membrane (0.45 μm) for Western Blot analysis. The membrane is blocked with skim milk to prevent non-specific binding interaction prior to incubation with the primary antibody (mouse anti-HIV p24 [ICN Biomedical]) for 30-60 minutes. Following washing, the membrane is incubated for 30-60 minutes with HRP-sheep anti-mouse IgG. Visualization of the protein bands is achieved by incubating the membrane with chemiluminescent substrates and exposing to X-ray film for 2-30 minutes. For quantitation, the intensity of the Gag-Pol-Nef protein band is compared to the intensity of t of the HIV-1 gag-β-gal fusion protein bands.

Analysis of Envelope protein expression by plasmids VRC-5305, VRC-2805, and VRC-5309 is determined in an analogous manner to that used for analysis of VRC-4306. Following transfection with the plasmid, cell lysate is harvested and analyzed by Western Blot analysis. For immunological detection, the membrane is incubated with human IgG antiserum against gp160 (NIH AIDS Research and Reference Reagent Program). Protein expression levels are quantitated by comparing the intensity of the envelope protein bands to those of the purified gp160 protein standard. Transfection efficiency is monitored using a galactosidase expression vector in a similar backbone.

Part VII

VRC-HIVDNA016-00-VP

Introduction

VRC-HIVDNA016-00-VP is a multi-plasmid DNA vaccine intended for use as a preventive vaccine for HIV-1. It is a mixture of six plasmids in equal concentration. It was constructed to produce Gag, Pol, Nef and Env HIV-1 proteins to potentially elicit broad immune responses to multiple HIV-1 subtypes isolated in human infections.

| Description Of The Drug Substance | |
|---|---|
| Name of the Drug Substance: | VRC-4401 (SEQ ID NO: 24) |
| Description: | HIV-1 Gag (Clade B) |
| Molecular Weight: | 3.9 MDa |
| Nucleotide Base Pairs: | 5886 |
| Name of the Drug Substance: | VRC-4409 (SEQ ID NO: 25) |
| Description: | HIV-1 Pol (Clade B) |
| Molecular Weight: | 4.8 MDa |
| Nucleotide Base Pairs: | 7344 |
| Name of the Drug Substance: | VRC-4404 (SEQ ID NO: 26) |
| Description: | HIV-1 Nef (Clade B) |
| Molecular Weight: | 3.3 MDa |
| Nucleotide Base Pairs: | 5039 |
| Name of the Drug Substance: | VRC-5736 (SEQ ID NO: 27) |
| Description: | HIV-1 Env (Clade A) |
| Molecular Weight: | 4.2 MDa |
| Nucleotide Base Pairs: | 6305 |
| Name of the Drug Substance: | VRC-5737 (SEQ ID NO: 28) |
| Description: | HIV-1 Env (Clade B) |
| Molecular Weight: | 4.2 MDa |
| Nucleotide Base Pairs: | 6338 |
| Name of the Drug Substance: | VRC-5738 (SEQ ID NO: 29) |
| Description: | HIV-1 Env (Clade C) |
| Molecular Weight: | 4.2 MDa |
| Nucleotide Base Pairs: | 6298 |

A. Construction of HIV-1 DNA Plasmids

The drug substances for VRC-HIVDNA016-00-VP are six closed circular plasmid DNA macromolecules (VRC-4401, VRC-4409, VRC-4404, VRC-5736, VRC 5737, and VRC-5738) that have been produced in bacterial cell cultures containing a kanamycin selection medium. In all cases, bacterial cell growth is dependent upon the cellular expression of the kanamycin resistance protein encoded by a portion of the plasmid DNA. Following growth of bacterial cells harboring the plasmid, the plasmid DNA is purified from cellular components.

Plasmids containing viral gene complementary DNAs (cDNAs) were used to subclone the relevant inserts into plasmid DNA expression vectors that use the CMV/R promoter and the bovine growth hormone polyadenylation sequence. The HIV-1 gene inserts have been modified to optimize expression in human cells. The CMV/R promoter consists of translational enhancer region of the CMV immediate early region 1 enhancer (CMV-IE) substituted with the 5'-untranslated HTLV-1 R-U5 region of the human T-cell leukemia virus type 1 (HTLV-1) long terminal repeat (LTR) to optimize gene expression further.

CMV/R-HIV-1 Clade B Gag/h (VRC-4401)

To construct DNA plasmid VRC-4401, diagrammed in FIG. 36, the protein sequence of the gag polyprotein (Pr55, amino acids 1-432) from HXB2 (GenBank accession number K03455) was used to create a synthetic version of the gag gene using codons optimized for expression in human cells. The nucleotide sequence of the synthetic gag gene shows little homology to the HXB2 gene, but the protein encoded is the same. The SalI/BamHI fragment of Gag (B) was excised from VRC 3900 (described in the WO 02/32943), which contained the same insert in a pVR1012 backbone, and cloned into the SalI/BamHI sites of the CMV/R backbone described above.

A summary of predicted VRC-4401 domains is provided in Table 8. The plasmid is 5886 nucleotide base pairs (bp) in length and has an approximate molecular weight of 3.9 MDa. The sequence of VRC-4401 is provided as SEQ ID NO: 24.

TABLE 8

Summary of Predicted Domains of VRC-4401; HIV-1 Gag (Clade B)

| Fragment Name or Protein Domain | Fragment Size (bp) | Predicted Fragment |
|---|---|---|
| pUC18 plasmid-derived | 247 | 1-247 |
| CMV-IE Enhancer/Promoter | 742 | 248-989 |
| HTLV-1 R region | 231 | 990-1220 |
| CMV IE Splicing Acceptor | 123 | 1221-1343 |
| Synthetic Linker | 31 | 1344-1374 |
| HIV-1 Gag (Clade B) | 1509 | 1375-2883 |
| Synthetic Linker | 23 | 2884-2906 |
| Bovine Growth Hormone Poly A | 548 | 2907-3454 |
| pUC18 plasmid-derived | 1311 | 3455-4765 |
| Kanamycin Resistance Gene | 816 | 4766-5581 |
| pUC18 plasmid-derived | 305 | 5582-5886 |

Construction of CMV/R Clade B Pol/h (VRC-4409)

To construct DNA plasmid VRC-4409 diagrammed in FIG. 37, the protein sequence of the pol polyprotein (amino acids 3-1003) from NL4-3 (GenBank accession number M19921) was used to create a synthetic version of the pol gene using codons optimized for expression in human cells. To initiate translation at the beginning of Pol, a methionine codon was added to the 5'-end of the synthetic polymerase gene to create the Pol/h gene. The Protease (PR) mutation is at amino acid 553 and is AGG→GGC or amino acids R→G. The Reverse Transcriptase (RT) mutation is at amino acid 771 and is GAC→CAC or amino acids D→H. The Integrase (IN) mutation is at amino acid 1209 and is ACT→CAT or amino acids D→A. The gene expressing Pol was inserted into the CMV/R backbone described above.

A summary of predicted VRC-4409 domains is provided in Table 9. The plasmid is 7344 nucleotide base pairs (bp) in length and has an approximate molecular weight of 4.8 MDa. The sequence of VRC-4409 is provided as SEQ ID NO: 25.

TABLE 9

Summary of Predicted Domains of VRC-4409; HIV-1 Pol (Clade B)

| Fragment Name or Protein Domain | Fragment Size (bp) | Predicted Fragment |
|---|---|---|
| pUC18 plasmid-derived | 247 | 1-247 |
| CMV-IE Enhancer/Promoter | 742 | 248-989 |
| HTLV-1 R region | 231 | 990-1220 |
| CMV IE Splicing Acceptor | 123 | 1221-1343 |
| Synthetic Linker | 5 | 1344-1348 |
| HIV-1 Pol (Clade B) (Pr-, RT-, IN-) | 3009 | 1349-4357 |
| Synthetic Linker | 7 | 4358-4364 |
| Bovine Growth Hormone Poly A | 548 | 4365-4912 |
| pUC18 plasmid-derived | 1311 | 4913-6223 |
| Kanamycin Resistance Gene | 816 | 6224-7039 |
| pUC18 plasmid-derived | 305 | 7040-7344 |

Construction of CMV/R HIV-1 Nef/h (VRC-4404)

To construct DNA plasmid VRC-4404, diagrammed in FIG. 38, the protein sequence of the Nef protein from HIV-1 NY5/BRU (LAV-1) clone pNL4-3 (GenBank accession number M19921) was used to create a synthetic version of the Nef gene (Nef/h) using codons optimized for expression in human cells. The nucleotide sequence Nef/h shows little homology to the viral gene, but the protein encoded is the same. The Myristol site (GGC-Gly, amino acid 2-3) was deleted. The fragment encoding Nef was digested from the pVR1012 backbone in which it was originally inserted, with XbaI/BamHI, and then cloned into the XbaI/BamHI site of the CMV/R backbone described above.

A summary of predicted VRC-4404 domains is provided in Table 10. The plasmid is 5039 nucleotide base pairs (bp) in length and has an approximate molecular weight of 3.3 MDa. The sequence of VRC-4404 is provided as SEQ ID NO: 26.

TABLE 10

Summary of Predicted Domains of VRC-4404; HIV-1 Nef (Clade B)

| Fragment Name or Protein Domain | Fragment Size (bp) | Predicted Fragment |
|---|---|---|
| pUC18 plasmid-derived | 247 | 1-247 |
| CMV-IE Enhancer/Promoter | 742 | 248-989 |
| HTLV-1 R region | 231 | 990-1220 |
| CMV IE Splicing Acceptor | 123 | 1221-1343 |
| Synthetic Linker | 48 | 1344-1391 |
| HIV-1 Nef (Clade B) (Delta Myr) | 615 | 1392-2006 |
| Synthetic Linker | 19 | 2007-2025 |
| Bovine Growth Hormone Poly A | 548 | 2026-2573 |
| pUC18 plasmid-derived | 1345 | 2574-3918 |
| Kanamycin Resistance Gene | 816 | 3919-4734 |
| pUC18 plasmid-derived | 305 | 4735-5039 |

CMV/R-HIV-1 Clade A Env/h (VRC-5736)

To construct DNA plasmid VRC-5736, diagrammed in FIG. 39, the protein sequence of the envelope polyprotein (gp160) from 92rw020 (R5-tropic, GenBank accession number U08794) was used to create a synthetic version of the gene (Clade-A gp145ΔCFI) using codons altered for expression in human cells. Plasmids expressing the HIV-1 genes were made synthetically with sequences designed to disrupt viral RNA structures that limit protein expression by using codons typically found in human cells. The nucleotide sequence R5gp145ΔCFI shows little homology to the 92rw020 gene, but the protein encoded is the same. The truncated envelope polyprotein contains the entire SU protein and the TM domain, but lacks the fusion domain and cytoplasmic domain. Regions important for oligomer formation may be partially functional. Heptad (H) 1, Heptad 2 and their Interspace (IS) are required for oligomerization. The Fusion and Cleavage (F/CL) domains, from amino acids 486-519, have been deleted. The Interspace (IS) between Heptad (H) 1 and 2, from amino acids 576-604, have been deleted. The XbaI (18 nt up-stream from ATG) to BamH1 (1912 nt down-stream from ATG) fragment which contains polylinker at the 5' end, Kozak sequence and ATG was cloned into the XbaI to BamH1 sites of the CMV/R backbone described above.

EnvA summary of predicted VRC-5736 domains is provided in Table 11. The plasmid is 6305 nucleotide base pairs (bp) in length and has an approximate molecular weight of 4.2 MDa. The sequence of VRC-5736 is provided as SEQ ID NO: 27.

TABLE 11

Summary of Predicted Domains of VRC-5736; HIV-1 Env (Clade A)

| Fragment Name or Protein Domain | Fragment Size (bp) | Predicted Fragment |
|---|---|---|
| pUC18 plasmid-derived | 247 | 1-247 |
| CMV-IE Enhancer/Promoter | 742 | 248-989 |
| HTLV-1 R region | 231 | 990-1220 |
| CMV IE Splicing Acceptor | 123 | 1221-1343 |
| Synthetic Linker | 48 | 1344-1391 |
| HIV-1 Env (Clade A), gp145 (ΔCFI)/h | 1881 | 1392-3272 |
| Synthetic Linker | 19 | 3273-3291 |
| Bovine Growth Hormone Poly A | 548 | 3292-3839 |
| pUC18 plasmid-derived | 1345 | 3840-5184 |
| Kanamycin Resistance Gene | 816 | 5185-6000 |
| pUC18 plasmid-derived | 305 | 6001-6305 |

Construction of CMV/R Clade B Env/h (VRC-5737)

To construct DNA plasmid VRC-5737 diagrammed in FIG. 40, the protein sequence of the envelope polyprotein (gp160) from HXB2 (X4-tropic, GenBank accession number K03455) was used to create a synthetic version of the gene (X4gp160/h) using codons optimized for expression in human cells. The nucleotide sequence X4gp160/h shows little homology to the HXB2 gene, but the protein encoded is the same with the following amino acid substitutions: F53L, N94D, K192S, I215N, A224T, A346D, and P470L. To produce an R5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GeneBank accession number M68893, again using human preferred codons). The full-length R5-tropic version of the envelope protein gene from pR5gp160/h (VRC3000, described in the WO 02/32943) was terminated after the codon for amino acid 704. The truncated envelope polyprotein (gp145) contains the entire SU protein and a portion of the TM protein including the fusion domain, the transmembrane domain, and regions important for oligomer formation. Heptad (H) 1, Heptad 2 and their Interspace (IS) are required for oligomerization. The Fusion and Cleavage (F/CL) domains, from amino acids 503-536, have been deleted. The Interspace (IS) between Heptad (H) 1 and 2, from amino acids 593-620, have been deleted. The expression vector backbone is CMV/R, described above.

A summary of predicted VRC-5737 domains is provided in Table 12. The plasmid is 6338 nucleotide base pairs (bp) in length and has an approximate molecular weight of 4.2 MDa. The sequence of VRC-5737 is provided as SEQ ID NO: 28.

TABLE 12

Summary of Predicted Domains of VRC-5737; HIV-1 Env (Clade B)

| Fragment Name or Protein Domain | Fragment Size (bp) | Predicted Fragment |
|---|---|---|
| pUC18 plasmid-derived | 247 | 1-247 |
| CMV-IE Enhancer/Promoter | 742 | 248-989 |
| HTLV-1 R region | 231 | 990-1220 |
| CMV IE Splicing Acceptor | 123 | 1221-1343 |
| Synthetic Linker | 40 | 1344-1383 |
| HIV-1 Env (Clade B), gp145 (ΔCFI)/h | 1929 | 1384-3312 |
| Synthetic Linker | 12 | 3313-3324 |
| Bovine Growth Hormone Poly A | 548 | 3325-3872 |
| pUC18 plasmid-derived | 1345 | 3873-5217 |
| Kanamycin Resistance Gene | 816 | 5218-6033 |
| pUC18 plasmid-derived | 305 | 6034-6338 |

Construction of CMV/R HIV-1 Clade C Env/h (VRC-5738)

To construct DNA plasmid VRC-5738, diagrammed in FIG. 41, the protein sequence of the envelope polyprotein (gp145ΔCFI) from 97ZA012 (R5-tropic, GenBank accession number AF286227) was used to create a synthetic version of the gene (Clade-C gp145ΔCFI) using codons optimized for expression in human cells. The nucleotide sequence R5gp145ΔCFI shows little homology to the gene 97ZA012, but the protein encoded is the same. The truncated envelope polyprotein contains the entire SU protein and the TM domain, but lacks the fusion domain and cytoplasmic domain. Regions important for oligomer formation may be partially functional. Heptad (H) 1, Heptad 2 and their Interspace (IS) are required for oligomerization. The Fusion and Cleavage (F/CL) domains, from amino acids 487-520, have been deleted. The Interspace (IS) between Heptad (H) 1 and 2, from amino acids 577-605, have been deleted. The XbaI (18 nt up-stream from ATG) to BamH1 (1914 nt down-stream from ATG) fragment which contains polylinker at the 5' end, Kozak sequence and ATG was cloned into the XbaI to BamH1 sites of the CMV/R backbone.

A summary of predicted VRC-5738 domains is provided in Table 13. The plasmid is 6298 nucleotide base pairs (bp) in length and has an approximate molecular weight of 4.2 MDa. The sequence of VRC-5738 is provided as SEQ ID NO: 29.

TABLE 13

Summary Table of Predicted Domains of VRC-5738; HIV-1 Env (Clade C)

| Fragment Name or Protein Domain | Fragment Size (bp) | Predicted Fragment |
|---|---|---|
| pUC18 plasmid-derived | 247 | 1-247 |
| CMV-IE Enhancer/Promoter | 742 | 248-989 |
| HTLV-1 R region | 231 | 990-1220 |
| CMV IE Splicing Acceptor | 123 | 1221-1343 |
| Synthetic Linker | 48 | 1344-1391 |
| HIV-1 Env (Clade C), gp145 (ΔCFI)/h | 1881 | 1392-3272 |
| Synthetic Linker | 12 | 3273-3284 |
| Bovine Growth Hormone Poly A | 548 | 3285-3832 |
| pUC18 plasmid-derived | 1345 | 3833-5177 |
| Kanamycin Resistance Gene | 816 | 5178-5993 |
| pUC18 plasmid-derived | 305 | 5994-6298 |

B. Analysis of HIV-1 Plasmid Sequence Homology to the Human Genome

VRC-4401, 4409, 4404, 5736, 5737 and 5738 plasmids were sequenced by Lark Technologies and the sequences subjected to a BLAST search of the human genome database. The search was done using parameters which only identified sequence homologies with expected values (E values) of 0.01 or lower. This means that the statistical possibility of a homology occurring by chance alone is only $1/100$. Anything at this level or lower (i.e. less than $1/100$) will be picked up by the search.

C. Analytical Methods for the Drug Substance

In Vitro Transfection and Expression Assay. Expression testing for the individual plasmids and the final formulated drug product will be conducted prior to release of the vaccine product. Qualitative expression of the plasmid proteins is verified by comparing the reactive protein bands on the Western blot with the standards run under the same conditions. Once the plasmids are combined, expression will be verified using the same assay procedures. Expression is determined by detecting proteins expressed by transfected 293 human embryonic kidney (HEK) cells. For transfection, $10^5$ to $10^6$ cells are transfected with 1-5 µg of plasmid DNA using the calcium phosphate method. Cells are incubated for 14-20 hours to allow for DNA uptake. Following a medium change, cells are grown for an additional 24-48 hours before harvesting. Transfection efficiency is monitored using a known similar vector in the same backbone. After cell lysis, 10 µg of an appropriate amount of total cellular protein is loaded onto an SDS-PAGE gel to separate the crude lysate proteins.

Following electrophoresis for approximately 1.5 hours, the proteins are transferred to a nitrocellulose membrane (0.45 µm) for Western blot analysis. The membrane is blocked with skim milk to prevent non-specific binding interaction prior to incubation with the primary antibody for 60 minutes. Following washing, the membrane is incubated for 45 minutes with HRP conjugated second antibody. Visualization of the protein bands is achieved by incubating the membrane with chemi-luminescent substrates and exposing to X-ray film for 2 minutes or an appropriate time. Expression of protein produced by transfected cells is determined by observing the intensity of expressed protein on the Western blot. The assay is being further developed to allow for semi-quantitative analysis of protein expression by the vaccine plasmids.

Part VIII

VRC NIH ADV014-00-VP

Description of the Study Agent VRC-HIVADV014-00-VP

The recombinant adenoviral vector product VRC-HIVADV014-00-VP (rAd) is a replication-deficient, combination vaccine containing four recombinant serotype 5 adenoviral vectors. These vectors contain gene sequences that code for Clade B HIV-1 Gag and Pol as well as Clade A, Clade B, and Clade C Env protein. In vivo expression by these vectors produces immunogens that induce an immune response against HIV. The envelope genes were chosen as representative primary isolates from each of the three clades.

The process for constructing the four VRC-HIVADV014-00-VP recombinant adenoviral vectors is based upon a rapid vector construction system (AdFAST™, GenVec, Inc.) used to generate adenoviral vectors that express the four HIV antigens gp140(A), gp140(B)dv12, gp140(C) and GagPol(B) driven by the cytomegalovirus (CMV) immediate-early promoter. Manufacturing is based upon production in a 293-ORF6 cell line (Brough, D. E. at al. 1996 J Virol 70:6497-6501), yielding adenoviral vectors that are replication deficient. The vectors are purified using CsCl centrifugation.

The product is formulated as a sterile liquid injectable dosage form for intramuscular injection.

1. Production of the gag-pol Adenoviral Vector

AdtGagPol(B).11D

SEQ ID NO: 33

The protein sequences of the Gag and Pol proteins from an HIV-1 Clade B were used to create a synthetic polyprotein version of the gag-pol genes using codons optimized for expression in human cells. The synthetic gag gene is from HIV-1 Clade B strain HXB2 (GenBank accession number K03455), and the synthetic pol gene (pol/h) is from HIV-1 Clade B NL4-3 (GenBank accession number M19921). The pol gene is nonfunctional because it is present as a fusion protein. Mutations were introduced in the synthetic protease and reverse transcriptase genes. The protease modification prevents processing of the pol gene product, and reduces the potential for functional protease, reverse transcriptase and integrase enzymatic activity. The cDNA used to produce Adt-GagPol(B).11D is similar to an HIV-1 DNA vaccine VRC-4302 (described in WO 02/32943) which was tested and shown to have no reverse transcriptase activity. No modifications were made to the gag. To construct the adenoviral vector, the HIV-1 DNA sequence was subcloned using standard recombinant DNA techniques into an expression cassette in an E1-shuttle plasmid.

2. Production of the env Adenoviral Vectors

Adgp140(A).11D

SEQ ID NO: 30

The protein sequence of the envelope polyprotein (gp160) from 92rw020 (CCR5-tropic, GenBank accession number U08794) was used to create a synthetic version of the gene (Clade-A gp140ΔCFI) using codons altered for expression in human cells. Plasmids expressing the HIV-1 genes were made synthetically with sequences designed to disrupt viral RNA structures that limit protein expression by using codons typically found in human cells. To construct the adenoviral vector, the HIV-1 DNA sequence was subcloned using standard recombinant DNA techniques into an expression cassette in an E1-shuttle plasmid.

Adtgp140dv12(B).11D

SEQ ID NO: 32

The protein sequence of the envelope polyprotein (gp160) from HXB2 (X4-tropic, GenBank accession number K03455) was used to create a synthetic version of the gene (X4gp160/h) using codons optimized for expression in human cells. To produce an CCR5-tropic version of the envelope protein (R5gp160/h), the region encoding HIV-1 envelope polyprotein amino acids 275 to 361 from X4gp160/h (VRC3300) were replaced with the corresponding region from the BaL strain of HIV-1 (GenBank accession number M68893, again using human preferred codons). The full-length CCR5-tropic version of the envelope protein gene from pR5gp160/h (VRC3000) was terminated after the codon for amino acid 680. The truncated Env glycoprotein (gp140) contains the entire surface protein and the ectodomain of gp41 including the fusion domain, and regions important for oligomer formation, specifically two helical coiled coil motifs. The Env V1 and V2 loops were deleted to improve the stability and yield of the vector in the producer cell line. Two additional amino acids were incorporated immediately after the deletion due to creation of a restriction enzyme site. In order to construct the adenoviral vector, the HIV-1 DNA sequence was subcloned using standard recombinant DNA techniques into an expression cassette in an E1-shuttle plasmid.

Adgp140(C).11D

SEQ ID NO: 31

The protein sequence of the envelope polyprotein (gp140ΔCFI) from 97ZA012 (CCR5-tropic, GenBank accession number AF286227) was used to create a synthetic version of the gene (Clade-C gp140ΔCFI) using codons optimized for expression in human cells. To construct the adenoviral vector, the HIV-1 DNA sequence was subcloned using standard recombinant DNA techniques into an expression cassette in an E1-shuttle plasmid.

All Four Adenoviral Vectors

The four E1-shuttle plasmid was recombined in *Escherichia coli* (*E. coli*) BjDE3 bacteria with the GV11 adenovector based AdFAST™ plasmid pAdE1(BN)E3(10)E4(TIS1) to generate the adenoviral vector plasmids. The replication-deficient adenoviral vectors AdtGagPol(B).11D, Adgp140(A).11D, Adtgp140dv12(B).11D, and Adgp140(C).11D were then generated by introducing the adenoviral vector plasmid into the packaging cell line, 293-ORF6.

Part IX

Clinical Data

Preliminary immunogenicity data through Week 12 from the clinical study (VRC-004) of VRC-HIVDNA-009-00-VP vaccine, when sorted by treatment assignment indicate that $CD4^+$ responses were detected in nearly 100% of recipients at all dose levels. $CD8^+$ responses were detected in nearly half. The greatest responses (in frequency and magnitude) were generally observed as directed against Env. Greater responses were observed in the 4 mg and 8 mg dose compared to the 2 mg dose, although not statistically significant given the small number of subjects at the 2 mg dose. A larger response was observed after 3 injections compared to 2 injections at both the 4 mg and 8 mg dose levels, although it was not statistically significant and there is no way to determine if this was due to the 3rd injection or simply a maturation of the response following the 2nd injection. Definitive cellular immune responses were first detectable with the 4 mg and 8 mg dose at the 6-week time point (2 weeks after the second injection).

Serological responses to immunizations were analyzed by ELISA and Western Blot. None of the 2 mg dose subjects showed evidence of humoral immunity by standard HIV ELISA or Western blot. HIV ELISA responses were detected in 11 of the 20 (55%) subjects vaccinated with the 4 mg dose, and 3 of 15 (20%) subjects vaccinated with the 8 mg dose. The study subjects with vaccine-induced antibody had indeterminate or negative Western blots. With the schedule of evaluations used in VRC 004, study week 8 is the earliest timepoint at which a positive vaccine-induced HIV ELISA was detected, although more often a positive ELISA was first detected at study week 12 and some have been first detected at later timepoints. It appears that over time the strength of the vaccine-induced HIV ELISA reaction diminishes as indicated by decreasing optical density (O.D.) measurements reported for sequential ELISA measurements.

Part X

Additional Constructs

TABLE 14

V3 1AB modified envelope constructs.

| VRC NO: | Construct | FIG. NO: | SEQ ID NO: |
|---|---|---|---|
| VRC 5747 | CMV/R-Clade B gp145(ΔCFI)(ΔV12)(V3-1AB-clade C-SA)/h | 46 | 38 |
| VRC 5753 | CMV/R-gp145(ΔCFI)(ΔV1-2)(ΔV3)(1AB)(Clade A) | 47 | 39 |
| VRC 5754 | CMV/R-gp145(ΔCFI)(ΔV1-2)(ΔV3)(1AB)(Clade SA-C) | 48 | 40 |
| VRC 5755 | pAdApt LoxP CMV TbGH(+) gp140ΔCFIΔV1V2(1AB)(Bal)/h | 49 | 41 |
| VRC 5766 | pAdApt LoxP CMV TbGH(+) gp140(ΔCFI)(V3-1AB) Clade A/h | 50 | 42 |
| VRC 5767 | pAdApt LoxP CMV TbGH(+) gp140(ΔCFI)(ΔV12)(V3-1AB)h Clade A | 51 | 43 |
| VRC 5768 | pAdApt LoxP CMV TbGH(+) gp140(ΔCFI)(ΔV1-2) Clade B(V3-1AB-clade A)/h | 52 | 44 |
| VRC 5769 | pAdApt LoxP CMV TbGH(+) gp140(ΔCFI)(V3-1AB) Clade C(SA)/h | 53 | 45 |
| VRC 5770 | pAdApt LoxP CMV TbGH(+) gp140(ΔCFI)(ΔV1-2)(V3-1AB)h Clade C(SA) | 54 | 46 |
| VRC 5771 | CMV/R gp145(ΔCFI)(V3-1AB)/h Clade A | 55 | 47 |
| VRC 5772 | CMV/R gp145(ΔCFI)(ΔV1-2)Clade B (V3-1AB-cladeA)/h | 56 | 48 |
| VRC 5773 | CMV/R gp145(ΔCFI)(V3-1AB)/h Clade C(SA) | 57 | 49 |

TABLE 15

Deletions and mutations in V1V2 region on Bal gp145ΔCFI(V3-1AB) backbone

| Construct | FIG. NO: | SEQ ID NO: |
|---|---|---|
| CMVR-gp145ΔCFIΔV1(V2ΔLR)(V3-1AB)(Bal) | 58 | 50 |
| CMVR-gp145ΔCFI(V12ΔG)(V3-1AB)(Bal) | 59 | 51 |
| CMVR-gp145ΔCFI(V1ΔG)(V2ΔLR)(V3-1AB)(Bal) | 60 | 52 |
| CMVR-gp145ΔCFI(V1ΔG)(V2ΔM)(V3-1AB)(Bal) | 61 | 53 |
| CMVR-gp145ΔCFI(V1ΔG)ΔV2(V3-1AB)(Bal) | 62 | 54 |
| CMVR-gp145ΔCFI(V1ΔLR)(V2ΔG)(V3-1AB)(Bal) | 63 | 55 |
| CMVR-gp145ΔCFI(V1ΔLR)ΔV2(V3-1AB)(Bal) | 64 | 56 |
| CMVR-gp145ΔCFI(V1ΔM)(V2ΔG)(V3-1AB)(Bal) | 65 | 57 |
| CMVR-gp145ΔCFI(V1ΔM)ΔV2(V3-1AB)(Bal) | 66 | 58 |
| CMVR-gp145ΔCFI(V3-1AB)(Bal) | 67 | 59 |
| CMVR-gp145ΔCFIΔV1(V2ΔG)(V3-1AB)(Bal) | 68 | 60 |
| CMVR-gp145ΔCFIΔV1(V2ΔM)(V3-1AB)(Bal) | 69 | 61 |
| CMVR-gp145ΔCFIΔV1(V3-1AB)(Bal) | 70 | 62 |
| CMVR-gp145ΔCFIΔV1V2(V3-1AB)(Bal) | 71 | 63 |
| CMVR-gp145ΔCFIΔV2(V3-1AB)(Bal) | 72 | 64 |

TABLE 16

Chimeric constructs.

| VRC NO: | Construct | FIG. NO: | SEQ ID NO: |
|---|---|---|---|
| VRC 5781 | pAdApt LoxP CMV TbGH(+) Bal-gp140ΔCFI(C1-V2-CSA)h | 73 | 65 |
| VRC 5782 | CMVR-Bal-gp145ΔCFI(C1-V2 clade C-SA)(CBBB) | 74 | 66 |
| VRC 5783 | pAdApt LoxP CMV TbGH(+) Bal-gp140ΔCFI(C2-C3-CSA)h(BCBB) | 75 | 67 |
| VRC 5784 | CMVR-Bal-gp145ΔCFI(C2-C3-CSA)h(BCBB) | 76 | 68 |
| VRC 5785 | pAdApt LoxP CMV TbGH(+) Bal-gp140ΔCFI(V4-C5-CSA)/h(BBCB) | 77 | 69 |
| VRC 5786 | CMVR-Bal-gp145ΔCFI(V4-C5-CSA)/h(BBCB) | 78 | 70 |
| VRC 5787 | pAdApt LoxP CMV TbGH(+) gp140ΔCFIM383(Bal)/h(BBBB) | 79 | 71 |
| VRC 5788 | CMVR-Bal-gp145ΔCFIM383(Bal)(BBBB) | 80 | 72 |
| VRC 5789 | pAdApt LoxP CMV TbGH(+) C(SA)gp140ΔCFI(C1-V2 Bal)/h(BCCC) | 81 | 73 |
| VRC 5790 | CMVR-C(SA)gp145ΔCFI(C1-V2 clade B-Bal)(BCCC) | 82 | 74 |
| VRC 5791 | pAdApt LoxP CMV TbGH(+) C(SA)gp140ΔCFI(C2-C3 Bal)/h(CBCC) | 83 | 75 |

TABLE 16-continued

Chimeric constructs.

| VRC NO: | Construct | FIG. NO: | SEQ ID NO: |
|---|---|---|---|
| VRC 5792 | CMVR-C(SA)gp145ΔCFI(C2-C3 clade B-Bal)(CBCC) | 84 | 76 |
| VRC 5793 | pAdApt LoxP CMV TbGH(+) C(SA)gp140ΔCFI(V4-C5 Bal)/h(CCBC) | 85 | 77 |
| VRC 5794 | CMVR-C(SA)gp145ΔCFI(V4-C5 clade B-Bal)/h(CCBC) | 86 | 78 |
| | CMVR gp145 ΔCFI (CCCC) | — | 79 |

SEQUENCE LISTING (79 sequences)

SEQ ID NO: 1 - protein, 35 aa, Artificial Sequence
  artificially mutated V3 loop
CTRPNNNTRKSIHIGPGRAFYTTGEIIGDIRQAHC

SEQ ID NO: 2 - protein, 30 aa, Artificial Sequence
  synthetic peptide
CTRPNNNTRKAIHIFYTTGEIIGDIRQAHC

SEQ ID NO: 3 - protein, 8 aa, Artificial Sequence
  synthetic peptide
LELDKWAS

SEQ ID NO: 4 - protein, 14 aa, Artificial Sequence
  synthetic peptide
KNEQELLELDKWAS

SEQ ID NO: 5 - protein, 14 aa, Artificial Sequence
  synthetic peptide
KNEKDLLALDSWRN

SEQ ID NO: 6 - protein, 29 aa, Artificial Sequence
  synthetic mutated peptide
CTRPTRKSIHIGPGRAFYTTGEIIRQAHC

SEQ ID NO: 7 - protein, 23 aa, Artificial Sequence
  synthetic mutated peptide
CTRPSIHIGPGRAFYTTIRQAHC

SEQ ID NO: 8 - protein, 17 aa, Artificial Sequence
  synthetic mutated peptide
CTRPIGPGRAFIRQAHC

SEQ ID NO: 9 - protein, 30 aa, Artificial Sequence
  synthetic mutated peptide
CTRPNNNTRKSIHIFYTTGEIIGDIRQAHC

SEQ ID NO: 10 - protein, 29 aa, Artificial Sequence
  synthetic mutated peptide
CTRPNNNTREIGPGRAFGEIIGDIRQAHC

SEQ ID NO: 11 - protein, 23 aa, Artificial Sequence
  synthetic mutated peptide
CTRPNNNIGPGRAFIGDIRQAHC

SEQ ID NO: 12 - protein, 5 aa, HIV
GPGRA

SEQ ID NO: 13 - protein, 33 aa, Artificial Sequence
  synthetic peptide
TRPNNNTRKSIHIGPGRAFYTTGEIIGDIRQAH

SEQ ID NO: 14 - protein, 23 aa, Artificial Sequence
  synthetic peptide
IGPGRATRPNNNFYTTGTRKSIH

SEQ ID NO: 15 - DNA, 30 bp, Artificial Sequence
  synthetic primer
cctctagacaccatgcgcgtgaaggagaag

SEQ ID NO: 16 - DNA, 38 bp, Artificial Sequence
  synthetic primer
ccgctagcgtcggtgcacttcaggctcacgcacagggg

SEQ ID NO: 17 - DNA, 38 bp, Artificial Sequence
  synthetic primer
ccgctagcaccagctgcaacaccagcgtgatcacccag

SEQ ID NO: 18 - DNA, 30 bp, Artificial Sequence
  synthetic primer
ggtgcaggggcccttgccgttgaacttctt

SEQ ID NO: 19 - protein, 8 aa, Artificial Sequence
  synthetic peptide
CTDASTSC

SEQ ID NO: 20 - DNA, 9790 bp, Artificial Sequence
  plasmid VRC-4306
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaatagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggcccttctagacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggacatgggcggcaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttccccgtgaccccccaggtgcccctgcgccccatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggacgaccccgagcgcgaggtgctggagtggcgcttcgacagccgcctggccttccaccacgtggcccgcgagctgcaccccgagtacttcaagaactgctgaggatcaattctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 21 - DNA, 6836 bp, Artificial Sequence
  plasmid VRC-5305
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattgcggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgcgcggcatccagaccagctggcagaacctgtggcgctggggcaccatgatcctgggcatgctggtgatctacagcgccgccgagaacctgtgggtggccgtgtactacggcgtgcccgtgtggaaggacgccgagaccaccctgttctgcgccagcgacgccaaggcctacgacaccgaggtgcacaacgtgtgggagacccacgcctgcgtgcccaccgaccccaacccccaggagatccacctggagaacgtgaccgaggacttcaacatgtggcgcaacaacatggtggagcagatgcacaccgacatcatcagcctgtgggaccagagcctgaagccctgcgtgaagctgacccccctgtgcgtgaccctggactgcaacgccaccgccagcaacgtgaccaacgagatgcgcaactgtagcttcaacatcaccaccgagctgaaggacaagaagcagcaggtgtacagcctgttctacaagctggacgtggtgcagatcaacgagaagaacgagaccgacaagtaccgcctgatcaactgcaacaccagcgccatcacccaggcctgccccaaggtgagcttcgagcccatccccatccactactgcgcccccgccggcttcgccatcctgaagtgcaaggacaccgagttcaacggtaccggcccctgcaagaacgtgagcaccgtgcagtgcacccacggcatccgaccggtgatcagcacccagctgctgctgaacggcagcctggccgaggagggcatccagatccgcagcgagaacatcaccaacaacgccaagaccatcatcgtgcagctggataaggccgtgaagatcaactgcacccgccccaacaacaacacccgcaagggcgtgcgcatcggccccggccaggccttctacgccaccggcggcatcatcggcgacatccgccaggcccactgccacgtgagccgcgccaagtggaacgacaccctgcgcggcgtggccaagaagctgcgcgagcacttcaagaacaagaccatcatcttcgagaagagcagcggcggcgacatcgagatcaccacccacagcttcatctgcggcggcgagttcttctactgcaacaccagcggcctgttcaacagcacctgggagagcaacagcaccgagagcaacaacaccaccagcaacgacaccatcaccctgacctgccgcatcaagcagatcatcaacatgtggcagaaggtgggccaggccatgtaccccccccccatccagggcgtgatccgctgcgagagcaacatcaccggcctgctgctgacccgcgacggcggcaacaacagcaccaacgagatcttccgccccggcggcggcaacatgcgcgacaactggcgcagcgagctgtacaagtacaaggtggtgaagatcgagcccctgggcgtggcccccagccgcgccaagcttaccgcccaggcccgccagctgctgagcggcatcgtgcagcagcagagcaacctgctgcgcgccatcgaggcccagcagcacatgctgaagctgaccgtgtggggcatcaagcagctgcaggcccgcgtgctggccgtggagcgctacctgaaggaccagcagctcgagatctgggacaacatgacctggctgcagtgggacaaggagatcagcaactacacccagatcatctacaacctgatcgaggagagccagaaccagcaggagaagaacgagcaggacctgctggccctggacaagtgggccagcctgtggaactggttcgacatcagccgctggctgtggtacatcaagatcttcatcatgatcgtgggcggcctgatcggcctgcgcatcgtgttcgccgtgctgagcgtgatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccctttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 22 - DNA, 6869 bp, Artificial Sequence
  plasmid VRC-2805
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctggttacgggtaacctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagctgctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 23 - DNA, 6829 bp, Artificial Sequence
  plasmid VRC-5309
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 24 - DNA, 5886 bp, Artificial Sequence
  plasmid VRC-4401
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagataaacttaagcttatgggcgcccgcgccagcgtgctgagcggcggcgagctggaccgctgggagaagatccgcctgcgccccggcggcaagaagaagtacaagctgaagcacatcgtgtgggccagccgcgagctggagcgcttcgccgtgaaccccggcctgctggagaccagcgagggctgccgccagatcctgggccagctgcagcccagcctgcagaccggcagcgaggagctgcgcagcctgtacaacaccgtggccaccctgtactgcgtgcaccagcgcatcgagatcaaggacaccaaggaggccctggacaagatcgaggaggagcagaacaagagcaagaagaaggcccagcaggccgccgccgacaccggccacagcaaccaggtgagccagaactaccccatcgtgcagaacatccagggccagatggtgcaccaggccatcagcccccgcaccctgaacgcctgggtgaaggtggtggaggagaaggccttcagccccgaggtgatccccatgttcagcgccctgagcgagggcgccaccccccaggacctgaacaccatgctgaacaccgtgggcggccaccaggccgccatgcagatgctgaaggagaccatcaacgaggaggccgccgagtgggaccgcgtgcaccccgtgcacgccggccccatcgcccccggccagatgcgcgagccccgcggcagcgacatcgccggcaccaccagcaccctgcaggagcagatcggctggatgaccaacaacccccccatccccgtgggcgagatctacaagcgctggatcatcctgggcctgaacaagatcgtgcgcatgtacagccccaccagcatcctggacatccgccagggccccaaggagcccttccgcgactacgtggaccgcttctacaagaccctgcgcgccgagcaggccagccaggaggtgaagaactggatgaccgagaccctgctggtgcagaacgccaaccccgactgcaagaccatcctgaaggccctgggccccgccgccaccctggaggagatgatgaccgcctgccagggcgtgggcggccccggccacaaggcccgcgtgctggccgaggccatgagccaggtgaccaacagcgccaccatcatgatgcagcgcggcaacttccgcaaccagcgcaagatcgtgaagtgcttcaactgcggcaaggagggccacaccgcccgcaactgccgcgccccccgcaagaagggctgctggaagtgcggcaaggagggccaccagatgaaggactgcaccgagcgacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggtaccgagctcggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 25 - DNA, 7344 bp, Artificial Sequence
  plasmid VRC-4409
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacatgagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagatagggggccagctgaaggaggccctgctggacaccggcgccgacgacaccgtgctggaggagatgaacctgcccggccgctggaagcccaagatgatcggcggcatcggcggcttcatcaaggtgggccagtacgaccagatcctgatcgagatctgcggccacaaggccatcggcaccgtgctggtgggccccacccccgtgaacatcatcggccgcaacctgctgacccagatcggctgcaccctgaacttccccatcagccccatcgagaccgtgcccgtgaagctgaagcccggcatggacggccccaaggtgaagcagtggcccctgaccgaggagaagatcaaggccctggtggagatctgcaccgagatggagaaggagggcaagatcagcaagatcggccccgagaacccctacaacacccccgtgttcgccatcaagaagaaggacagcaccaagtggcgcaagctggtggacttccgcgagctgaacaagcgcacccaggacttctgggaggtgcagctgggcatcccccaccccgccggcctgaagcagaagaagagcgtgaccgtgctggacgtgggcgacgcctacttcagcgtgcccctggacaaggacttccgcaagtacaccgccttcaccatccccagcatcaacaacgagacccccggcatccgctaccagtacaacgtgctgccccagggctggaagggcagccccgccatcttccagtgcagcatgaccaagatcctggagcccttccgcaagcagaaccccgacatcgtgatctaccagtacatggaccacctgtacgtgggcagcgacctggagatcggccagcaccgcaccaagatcgaggagctgcgccagcacctgctgcgctggggcttcaccacccccgacaagaagcaccagaaggagccccccttcctgtggatgggctacgagctgcaccccgacaagtggaccgtgcagcccatcgtgctgcccgagaaggacagctggaccgtgaacgacatccagaagctggtgggcaagctgaactgggccagccagatctacgccggcatcaaggtgcgccagctgtgcaagctgctgcgcggcaccaaggccctgaccgaggtggtgcccctgaccgaggaggccgagctggagctggccgagaaccgcgagatcctgaaggagcccgtgcacggcgtgtactacgaccccagcaaggacctgatcgccgagatccagaagcagggccagggccagtggacctaccagatctaccaggagcccttcaagaacctgaagaccggcaagtacgcccgcatgaagggcgcccacaccaacgacgtgaagcagctgaccgaggccgtgcagaagatcgccaccgagagcatcgtgatctggggcaagacccccaagttcaagctgcccatccagaaggagacctgggaggcctggtggaccgagtactggcaggccacctggatccccgagtgggagttcgtgaacaccccccccctggtgaagctgtggtaccagctggagaaggagcccatcatcggcgccgagaccttctacgtggacggcgccgccaaccgcgagaccaagctgggcaaggccggctacgtgaccgaccgcggccgccagaaggtggtgcccctgaccgacaccaccaaccagaagaccgagctgcaggccatccacctggccctgcaggacagcggcctggaggtgaacatcgtgaccgacagccagtacgccctgggcatcatccaggcccagcccgacaagagcgagagcgagctggtgagccagatcatcgagcagctgatcaagaaggagaaggtgtacctggcctgggtgcccgcccacaagggcatcggcggcaacgagcaggtggacggcctggtgagcgccggcatccgcaaggtgctgttcctggacggcatcgacaaggcccaggaggagcacgagaagtaccacagcaactggcgcgccatggccagcgacttcaacctgccccccgtggtggccaaggagatcgtggccagctgcgacaagtgccagctgaagggcgaggccatgcacggccaggtggactgcagccccggcatctggcagctggcatgcacccacctggagggcaaggtgatcctggtggccgtgcacgtggccagcggctacatcgaggccgaggtgatccccgccgagaccggccaggagaccgcctacttcctgctgaagctggccggccgctggcccgtgaagaccgtgcacaccgacaacggcagcaacttcaccagcaccaccgtgaaggccgcctgctggtgggccggcatcaagcaggagttcggcatcccctacaacccccagagccagggcgtgatcgagagcatgaacaaggagctgaagaagatcatcggccaggtgcgcgaccaggccgagcacctgaagaccgccgtgcagatggccgtgttcatccacaacttcaagcgcaagggcggcatcggcggctacagcgccggcgagcgcatcgtggacatcatcgccaccgacatccagaccaaggagctgcagaagcagatcaccaagatccagaacttccgcgtgtactaccgcgacagccgcgaccccgtgtggaagggccccgccaagctgctgtggaagggcgagggcgccgtggtgatccaggacaacagcgacatcaaggtggtgccccgccgcaaggccaagatcatccgcgactacggcaagcagatggccggcgacgactgcgtggccagccgccaggacgaggactaggaattctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaatttcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 26 - DNA, 5039 bp, Artificial Sequence
  plasmid VRC-4404
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccgccatgaagtggagcaagagcagcgtgatcggctggcccgccgtgcgcgagcgcatgcgccgcgccgagcccgccgccgacggcgtgggcgccgtgagccgcgacctggagaagcacggcgccatcaccagcagcaacaccgccgccaacaacgccgcctgcgcctggctggaggcccaggaggaggaggaggtgggcttccccgtgaccccccaggtgcccctgcgccccatgacctacaaggccgccgtggacctgagccacttcctgaaggagaagggcggcctggagggcctgatccacagccagcgccgccaggacatcctggacctgtggatctaccacacccagggctacttccccgactggcagaactacacccccggccccggcgtgcgctaccccctgaccttcggctggtgctacaagctggtgcccgtggagcccgacaaggtggaggaggccaacaagggcgagaacaccagcctgctgcaccccgtgagcctgcacggcatggacgaccccgagcgcgaggtgctggagtggcgcttcgacagccgcctggccttccaccacgtggcccgcgagctgcaccccgagtacttcaagaactgctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 27 - DNA, 6305 bp, Artificial Sequence
  plasmid VRC-5736
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgcgcggcatccagaccagctggcagaacctgtggcgctggggcaccatgatcctgggcatgctggtgatctacagcgccgccgagaacctgtgggtggccgtgtactacggcgtgcccgtgtggaaggacgccgagaccaccctgttctgcgccagcgacgccaaggcctacgacaccgaggtgcacaacgtgtgggagacccacgcctgcgtgcccaccgaccccaacccccaggagatccacctggagaacgtgaccgaggacttcaacatgtggcgcaacaacatggtggagcagatgcacaccgacatcatcagcctgtgggaccagagcctgaagccctgcgtgaagctgacccccctgtgcgtgaccctggactgcaacgccaccgccagcaacgtgaccaacgagatgcgcaactgtagcttcaacatcaccaccgagctgaaggacaagaagcagcaggtgtacagcctgttctacaagctggacgtggtgcagatcaacgagaagaacgagaccgacaagtaccgcctgatcaactgcaacaccagcgccatcacccaggcctgccccaaggtgagcttcgagcccatccccatccactactgcgcccccgccggcttcgccatcctgaagtgcaaggacaccgagttcaacggtaccggcccctgcaagaacgtgagcaccgtgcagtgcacccacggcatccgaccggtgatcagcacccagctgctgctgaacggcagcctggccgaggagggcatccagatccgcagcgagaacatcaccaacaacgccaagaccatcatcgtgcagctggataaggccgtgaagatcaactgcacccgccccaacaacaacacccgcaagggcgtgcgcatcggccccggccaggccttctacgccaccggcggcatcatcggcgacatccgccaggcccactgccacgtgagccgcgccaagtggaacgacaccctgcgcggcgtggccaagaagctgcgcgagcacttcaagaacaagaccatcatcttcgagaagagcagcggcggcgacatcgagatcaccacccacagcttcatctgcggcggcgagttcttctactgcaacaccagcggcctgttcaacagcacctgggagagcaacagcaccgagagcaacaacaccaccagcaacgacaccatcaccctgacctgccgcatcaagcagatcatcaacatgtggcagaaggtgggccaggccatgtaccccccccccatccagggcgtgatccgctgcgagagcaacatcaccggcctgctgctgacccgcgacggcggcaacaacagcaccaacgagatcttccgccccggcggcggcaacatgcgcgacaactggcgcagcgagctgtacaagtacaaggtggtgaagatcgagcccctgggcgtggcccccagccgcgccaagcttaccgcccaggcccgccagctgctgagcggcatcgtgcagcagcagagcaacctgctgcgcgccatcgaggcccagcagcacatgctgaagctgaccgtgtggggcatcaagcagctgcaggcccgcgtgctggccgtggagcgctacctgaaggaccagcagctcgagatctgggacaacatgacctggctgcagtgggacaaggagatcagcaactacacccagatcatctacaacctgatcgaggagagccagaaccagcaggagaagaacgagcaggacctgctggccctggacaagtgggccagcctgtggaactggttcgacatcagccgctggctgtggtacatcaagatcttcatcatgatcgtgggcggcctgatcggcctgcgcatcgtgttcgccgtgctgagcgtgatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccctttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 28 - DNA, 6338 bp, Artificial Sequence
  plasmid VRC-5737
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacctgaagaacgacaccaacaccaacagcagcagcggccgcatgatcatggagaagggcgagatcaagaactgcagcttcaacatcagcaccagcatccgcggcaaggtgcagaaggagtacgccttcttctacaagctggacatcatccccatcgacaacgacaccaccagctacagcctgaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctggttacgggtaacctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagctgctcgagcagatctggaaccacaccacctggatggagtgggaccgcgagatcaacaactacaccagcctgatccacagcctgatcgaggagagccagaaccagcacgagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 29 - DNA, 6298 bp, Artificial Sequence
  plasmid VRC-5738
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 30 - DNA, 33583 bp, Artificial Sequence
  adenoviral vector Adgp140(A).11D
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggcccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagactagctagactcgagagcggccgcaatcgataagcttgatgatcccacgtgttcaccacagccagcggctgatgtcgaaccagttccacaggctggcccacttgtccagggccagcaggtcctgctcgttcttctcctgctggttctggctctcctcgatcaggttgtagatgatctgggtgtagttgctgatctccttgtcccactgcagccaggtcatgttgtcccagatctcgagctgctggtccttcaggtagcgctccacggccagcacgcgggcctgcagctgcttgatgccccacacggtcagcttcagcatgtgctgctgggcctcgatggcgcgcagcaggttgctctgctgctgcacgatgccgctcagcagctggcgggcctgggcggtaagcttggcgcggctgggggccacgcccaggggctcgatcttcaccaccttgtacttgtacagctcgctgcgccagttgtcgcgcatgttgccgccgccggggcggaagatctcgttggtgctgttgttgccgccgtcgcgggtcagcagcaggccggtgatgttgctctcgcagcggatcacgccctggatggggggggggtacatggcctggcccaccttctgccacatgttgatgatctgcttgatgcggcaggtcagggtgatggtgtcgttgctggtggtgttgttgctctcggtgctgttgctctcccaggtgctgttgaacaggccgctggtgttgcagtagaagaactcgccgccgcagatgaagctgtgggtggtgatctcgatgtcgccgccgctgctcttctcgaagatgatggtcttgttcttgaagtgctcgcgcagcttcttggccacgccgcgcagggtgtcgttccacttggcgcggctcacgtggcagtgggcctggcggatgtcgccgatgatgccgccggtggcgtagaaggcctggccggggccgatgcgcacgcccttgcgggtgttgttgttggggcgggtgcagttgatcttcacggccttatccagctgcacgatgatggtcttggcgttgttggtgatgttctcgctgcggatctggatgccctcctcggccaggctgccgttcagcagcagctgggtgctgatcaccggtcggatgccgtgggtgcactgcacggtgctcacgttcttgcaggggccggtaccgttgaactcggtgtccttgcacttcaggatggcgaagccggcgggggcgcagtagtggatggggatgggctcgaagctcaccttggggcaggcctgggtgatggcgctggtgttgcagttgatcaggcggtacttgtcggtctcgttcttctcgttgatctgcaccacgtccagcttgtagaacaggctgtacacctgctgcttcttgtccttcagctcggtggtgatgttgaagctacagttgcgcatctcgttggtcacgttgctggcggtggcgttgcagtccagggtcacgcacaggggggtcagcttcacgcagggcttcaggctctggtcccacaggctgatgatgtcggtgtgcatctgctccaccatgttgttgcgccacatgttgaagtcctcggtcacgttctccaggtggatctcctgggggttggggtcggtgggcacgcaggcgtgggtctcccacacgttgtgcacctcggtgtcgtaggccttggcgtcgctggcgcagaacagggtggtctcggcgtccttccacacgggcacgccgtagtacacggccacccacaggttctcggcggcgctgtagatcaccagcatgcccaggatcatggtgccccagcgccacaggttctgccagctggtctggatgccgcgcacgcgcatggtggcgatatctctagatcgaattctgcagtgatcagggatcccagatccgtatagtgagtcgtattaggtaccggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagcgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgccagtgtgatggatatctgcagaattccagcacactggcggccgttactagtggatccgagctcggtacccggccgttataacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 31 - DNA, 33589 bp, Artificial Sequence
  adenoviral vector Adgp140(C).11D
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggcccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagactagctagactcgagagcggccgcaatcgataagcttgatctagagatgatcctcaccacagccagttggagatgtcgaaccaggaccacaggtttttccaggagtccagagccagcaggtctttttcgtttttttcctgctgggtctgggagtcttccagcagacggtagatggtgtcggtgtagttggagatttcacggtcccattccatccaggtcatgttgttccagatctcgagctgctggtctttcaggtaacgttcgatagccagaacacgggtctgcagctgtttgataccccaaacggtcagctgcagcatgtgctgctgagcttcgatagcacgcagcaggttggactgctgctgaacgatggaggacagcagctgacgagcctgaacggtaagcttagcaccggtcggagcgatacccagcggtttcagttcgataactttgtatttgtacagttcggaacgccagttgtctttcatgttaccaccacccggacggaagatttcttcggttttgttgtcttcaccaccgtcacgaaccagcagcagaccggtgatgttggatttgcaggtgatgttaccagcgatcggcggagcgtacatagcacgaccaacaccctgccacatgttgatgatctgtttgatacggcacggcagggtgatggtttcgtcttcggtagcgttgttgttgaacagacgggtggtgttgcagtagaagaattcaccacggcagttgaaggagtgggtggtgatttccaggtcaccaccggaggacggagcgaatttgatggttttgttgttgttgtagttttcctgcagtttttctttaacacgtttcagggtttcgttccatttggaaccggagatgttgcagtaagcctgacggatgtcaccgatgatgtcaccggtagcgtagaaggtctgacccggaccgatacgcatggatttacgggtgttgttgttcggacgggtgcaaacgatttcaacggatttgttcaggtgaacgatgatggttttaacgttgtcggtcaggttttcggaacggatgatgatttctttttcagccagggaaccgttcagcagcagctgggtggaaacaaccggtttgataccatgggtgcactgaacggtggaaacgttgttgcacggacctttaccggagaaggttttgttgttgcatttcaggatagcgtaaccagccggagcgcagtagtggatcgggatcgggtcgaagttaactttcgggcaagcctgggtgatggtggaagcgttgcagttgatcaggatgtattcggagttgttggagttgttacggttttctttcagcagaacgatgtccggacggtagaacagagcgtaaccctgctgttttttgtcacggatttcggtggtggtgttgaaggagcagttacggatttctttgttcatgtcgttggtaacgttgtttttgaaggtagcgttggtgcagtgcagggtaacgcacagcggggtcagtttaacgcacggtttcagggactggtcccacagggagatgatgtcttcgtgcatctggtcaaccatgtcgtttttccacatgttgaagttttcggtaacgttttccagaacgatttcctgcgggttcgggtcggtcggaacgcaagcgtgggtagcccaaacgttgtgaacttcacggtcgtaggctttggtgtcggaagcgcagaacagggtggttttagcgtcggtccaaaccggaacaccgtagtaaacggtaacccacatgttaccaacaacacggcagatgatgatcatccagaaacccaggataccccacatccaccactgcggccagttacgcgggataccacgaacacgcatggtggcgatatctctagtcatcgaattctgcagtgatcagggatcccagatccgtatagtgagtcgtattaggtaccggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagcgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgccagtgtgatggatatctgcagaattccagcacactggcggccgttactagtggatccgagctcggtacccggccgttataacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 32 - DNA, 33476 bp, Artificial Sequence
  adenoviral vector B287-B Adt.gp140dv12(B).11D
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggcccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagactagctagactcgagagcggccgcaatcgataagcttgatatcgaattctgcagtgatcagggatcctcaccacagccagttggtgatgttgaaccagttccacaggctggcccacttgtccagctccagcagctcctgctcgttcttctcgtgctggttctggctctcctcgatcaggctgtggatcaggctggtgtagttgttgatctcgcggtcccactccatccaggtggtgtggttccagatctgctcgagcagctgctggtccttcaggtagcgctccacggccagggtgcgggcctgcagctgcttgatgccccacacggtcagctgcagcaggtgctgctgggcctcgatggcgcgcagcaggttgttctgctgctgcacgatgccgctcagcagctggcgggcctggacggtaagcttggccttggtgggggccacgcccaggggctcgatcttcaccaccttgtacttgtacagctcgctgcgccagttgtcgcgcatgtcgccgccgcccaggcggaagatctcgctctcgttgttgctgttgccgccgtcgcgggtcagcagcaggccggtgatgttgctgctgcagcggatctggccgctgatggggggggcgtacatggccttgcccaccttctgccacatgttgatgatctgcttgatgcggcagggcagggtgatggtgtcgctgccctcggtgttgttgctgccctcggtgctccaggtgctgttgaaccaggtgctgttgaacagctgggtgctgttgcagtagaagaactcgccgccgcagttgaagctgtgggtcacgatctcggggtcgccgccgctgctgtgcttgaacacgatggtcttgttgccgaactgctcgcgcagcttgatcacgatcttgttcagggtgtcgttccacttggcgcggctcaggttgcagtgggcctggcggatgtcgccgatgatctcgccggtggtgtagaaggcgcggccggggccgatgtggatgctcttgcgggtgttgttgttggggcgggtgcagttgatctccacgctctcgttcagctgcacgatgatcaccttggcgttgtcggcgaagttagcgctgcggatcaccacctcctcctcggccaggttacccgtaaccagcagctgggtgctcaccacggggcggatgccgtgggtgcactgcacggtgctcacgttggtgcaggggcccttgccgttgaacttcttgtccttgcacttcaggatggcgaagccggcgggggcgcagtagtggttggggatgggctcgaagctcaccttggggcaggcctgggtgatcacgctggtgttgcagctggtgctagcgtcggtgcacttcaggctcacgcacaggggggtcagcttcacgcagggcttcaggctctggtcccacaggctgatgatgtcctcgtgcatctgctccaccatgtcgttcttccacatgtcgaagttctcggtcacgttcaccagcaccacctcctgggggttggggtcggtgggcacgcaggcgtgggtggcccacacgttgtgcacctcggtgtcgtaggccttggcgtcgctggcgcagagcagggtggtggtggcctccttccacacgggcacgccgtagtacacggtcacccacagcttctcggtggcgctgcagatcatcagcatgcccagcagcatggtgccccagcgccagccccagcgccacaggtgctggtacttctccttcacgcgcatggtgtctagagcggccgcgatcggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgtcgacgatctctatcactgatagggagatctctatcactgatagggagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagcgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgccagtgtgatggatatctgcagaattccagcacactggcggccgttactagtggatccgagctcggtacccggccgttataacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 33 - DNA, 36066 bp, Artificial Sequence
  adenoviral vector GV326A Adt.GagPol(B).11D
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggcccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagaattcctagtcctcgtcctggcggctggccacgcagtcgtcgccggccatctgcttgccgtagtcgcggatgatcttggccttgcggcggggcaccaccttgatgtcgctgttgtcctggatcaccacggcgccctcgcccttccacagcagcttggcggggcccttccacacggggtcgcggctgtcgcggtagtacacgcggaagttctggatcttggtgatctgcttctgcagctccttggtctggatgtcggtggcgatgatgtccacgatgcgctcgccggcgctgtagccgccgatgccgcccttgcgcttgaagttgtggatgaacacggccatctgcacggcggtcttcaggtgctcggcctggtcgcgcacctggccgatgatcttcttcagctccttgttcatgctctcgatcacgccctggctctgggggttgtaggggatgccgaactcctgcttgatgccggcccaccagcaggcggccttcacggtggtgctggtgaagttgctgccgttgtcggtgtgcacggtcttcacgggccagcggccggccagcttcagcaggaagtaggcggtctcctggccggtctcggcggggatcacctcggcctcgatgtagccgctggccacgtgcacggccaccaggatcaccttgccctccaggtgggtgcagtccagctgccagatgccggggctgcagtccacctggccgtgcatggcctcgcccttcagctggcacttgtcgcagctggccacgatctccttggccaccacggggggcaggttgaagtcgctggccatggcgcgccagttgctgtggtacttctcgtgctcctcctgggccttgtcgatgccgtccaggaacagcaccttgcggatgccggcgctcaccaggccgtccacctgctcgttgccgccgatgcccttgtgggcgggcacccaggccaggtacaccttctccttcttgatcagctgctcgatgatctggctcaccagctcgctctcgctcttgtcgggctgggcctggatgatgcccagggcgtactggctgtcggtcacgatgttcacctccaggccgctgtcctgcagggccaggtggatggcctgcagctcggtcttctggttggtggtgtcggtcaggggcaccaccttctggcggccgcggtcggtcacgtagccggccttgcccagcttggtctcgcggttggcggcgccgtccacgtagaaggtctcggcgccgatgatgggctccttctccagctggtaccacagcttcaccagggggggggtgttcacgaactcccactcggggatccaggtggcctgccagtactcggtccaccaggcctcccaggtctccttctggatgggcagcttgaacttgggggtcttgccccagatcacgatgctctcggtggcgatcttctgcacggcctcggtcagctgcttcacgtcgttggtgtgggcgcccttcatgcgggcgtacttgccggtcttcaggttcttgaagggctcctggtagatctggtaggtccactggccctggccctgcttctggatctcggcgatcaggtccttgctggggtcgtagtacacgccgtgcacgggctccttcaggatctcgcggttctcggccagctccagctcggcctcctcggtcaggggcaccacctcggtcagggccttggtgccgcgcagcagcttgcacagctggcgcaccttgatgccggcgtagatctggctggcccagttcagcttgcccaccagcttctggatgtcgttcacggtccagctgtccttctcgggcagcacgatgggctgcacggtccacttgtcggggtgcagctcgtagcccatccacaggaaggggggctccttctggtgcttcttgtcgggggtggtgaagccccagcgcagcaggtgctggcgcagctcctcgatcttggtgcggtgctggccgatctccaggtcgctgcccacgtacaggtggtccatgtactggtagatcacgatgtcggggttctgcttgcggaagggctccaggatcttggtcatgctgcactggaagatggcggggctgcccttccagccctggggcagcacgttgtactggtagcggatgccgggggtctcgttgttgatgctggggatggtgaaggcggtgtacttgcggaagtccttgtccaggggcacgctgaagtaggcgtcgcccacgtccagcacggtcacgctcttcttctgcttcaggccggcggggtgggggatgcccagctgcacctcccagaagtcctgggtgcgcttgttcagctcgcggaagtccaccagcttgcgccacttggtgctgtccttcttcttgatggcgaacacgggggtgttgtaggggttctcggggccgatcttgctgatcttgccctccttctccatctcggtgcagatctccaccagggccttgatcttctcctcggtcaggggccactgcttcaccttggggccgtccatgccgggcttcagcttcacgggcacggtctcgatggggctgatggggaagttcagggtgcagccgatctgggtcagcaggttgcggccgatgatgttcacgggggtggggcccaccagcacggtgccgatggccttgtggccgcagatctcgatcaggatctggtcgtactggcccaccttgatgaagccgccgatgccgccgatcatcttgggcttccagcggccgggcaggttcatctcctccagcacggtgtcgtcggcgccggtgtctagaagggcctccttcagctggccccctatctttattgtgacgaggggtcgctgccaaagagtgatctgagggaagctaaaggatacagttccttgtctatcggctcctgcttctgagagggagttgttgtctcttccccaaacctgaagctctcttctggtggggctgttggctctggtctgctctgaagaaaattccctggccttcccttgtgggaaggccagatcttccctattagcctgtcgctcggtgcagtccttcatctggtggccctccttgccgcacttccagcagcccttcttgcggggggcgcggcagttgcgggcggtgtggccctccttgccgcagttgaagcacttcacgatcttgcgctggttgcggaagttgccgcgctgcatcatgatggtggcgctgttggtcacctggctcatggcctcggccagcacgcgggccttgtggccggggccgcccacgccctggcaggcggtcatcatctcctccagggtggcggcggggcccagggccttcaggatggtcttgcagtcggggttggcgttctgcaccagcagggtctcggtcatccagttcttcacctcctggctggcctgctcggcgcgcagggtcttgtagaagcggtccacgtagtcgcggaagggctccttggggccctggcggatgtccaggatgctggtggggctgtacatgcgcacgatcttgttcaggcccaggatgatccagcgcttgtagatctcgcccacggggatgggggggttgttggtcatccagccgatctgctcctgcagggtgctggtggtgccggcgatgtcgctgccgcggggctcgcgcatctggccgggggcgatggggccggcgtgcacggggtgcacgcggtcccactcggcggcctcctcgttgatggtctccttcagcatctgcatggcggcctggtggccgcccacggtgttcagcatggtgttcaggtcctggggggtggcgccctcgctcagggcgctgaacatggggatcacctcggggctgaaggccttctcctccaccaccttcacccaggcgttcagggtgcgggggctgatggcctggtgcaccatctggccctggatgttctgcacgatggggtagttctggctcacctggttgctgtggccggtgtcggcggcggcctgctgggccttcttcttgctcttgttctgctcctcctcgatcttgtccagggcctccttggtgtccttgatctcgatgcgctggtgcacgcagtacagggtggccacggtgttgtacaggctgcgcagctcctcgctgccggtctgcaggctgggctgcagctggcccaggatctggcggcagccctcgctggtctccagcaggccggggttcacggcgaagcgctccagctcgcggctggcccacacgatgtgcttcagcttgtacttcttcttgccgccggggcgcaggcggatcttctcccagcggtccagctcgccgccgctcagcacgctggcgcgggcgcccatgtcgaatcgaattctgcagtgatcagggatccgtatagtgagtcgtattaggtaccggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgtcgacgatctctatcactgatagggagatctctatcactgatagggagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagcgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgccagtgtgatggatatctgcagaattccagcacactggcggccgttactagtggatccgagctcggtacccggccgttataacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 34 - protein, 8 aa, Artificial Sequence
  peptide deletion
CTDASKNC

SEQ ID NO: 35 - protein, 8 aa, Artificial Sequence
  peptide deletion
CSFASTSC

SEQ ID NO: 36 - protein, 8 aa, Artificial Sequence
  peptide deletion
CTRASAHC

SEQ ID NO: 37 - protein, 8 aa, Artificial Sequence
  peptide deletion
CNSASLPC

SEQ ID NO: 38 - DNA, 6133 bp, Artificial Sequence
  plasmid VRC 5747
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctggttacgggtaacctggccgaggaggaggtggtgatccgcagcgctaacttcgccgacaacgccaaggtgatcatcgtgcagctgaacgagagcgtggagatcaactgcacccgccccacccgcaagagcatgcgtatcggtccgggtcagaccttctacgctaccggtgacatcatccgtcaggcttactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 39 - DNA, 6130 bp, Artificial Sequence
  plasmid VRC 5753
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgcgcggcatccagaccagctggcagaacctgtggcgctggggcaccatgatcctgggcatgctggtgatctacagcgccgccgagaacctgtgggtggccgtgtactacggcgtgcccgtgtggaaggacgccgagaccaccctgttctgcgccagcgacgccaaggcctacgacaccgaggtgcacaacgtgtgggagacccacgcctgcgtgcccaccgaccccaacccccaggagatccacctggagaacgtgaccgaggacttcaacatgtggcgcaacaacatggtggagcagatgcacaccgacatcatcagcctgtgggaccagagcctgaagccctgcgtgaagctgacccccctgtgcgtgaccctggactgccaagccgctagcatcaactgccaaaccagcgccatcacccaggcctgccccaaggtgagcttcgagcccatccccatccactactgcgcccccgccggcttcgccatcctgaagtgcaaggacaccgagttcaacggtaccggcccctgcaagaacgtgagcaccgtgcagtgcacccacggcatccgaccggtgatcagcacccagctgctgctgaacggcagcctggccgaggagggcatccagatccgcagcgagaacatcaccaacaacgccaagaccatcatcgtgcagctggataaggccgtgaagatcaactgcacccgccccacccgcaagggcgtgcgcatcggccccggccaggccttctacgccaccggcggcatcatccgccaggcccactgccacgtgagccgcgccaagtggaacgacaccctgcgcggcgtggccaagaagctgcgcgagcacttcaagaacaagaccatcatcttcgagaagagcagcggcggcgacatcgagatcaccacccacagcttcatctgcggcggcgagttcttctactgcaacaccagcggcctgttcaacagcacctgggagagcaacagcaccgagagcaacaacaccaccagcaacgacaccatcaccctgacctgccgcatcaagcagatcatcaacatgtggcagaaggtgggccaggccatgtaccccccccccatccagggcgtgatccgctgcgagagcaacatcaccggcctgctgctgacccgcgacggcggcaacaacagcaccaacgagatcttccgccccggcggcggcaacatgcgcgacaactggcgcagcgagctgtacaagtacaaggtggtgaagatcgagcccctgggcgtggcccccagccgcgccaagcttaccgcccaggcccgccagctgctgagcggcatcgtgcagcagcagagcaacctgctgcgcgccatcgaggcccagcagcacatgctgaagctgaccgtgtggggcatcaagcagctgcaggcccgcgtgctggccgtggagcgctacctgaaggaccagcagctcgagatctgggacaacatgacctggctgcagtgggacaaggagatcagcaactacacccagatcatctacaacctgatcgaggagagccagaaccagcaggagaagaacgagcaggacctgctggccctggacaagtgggccagcctgtggaactggttcgacatcagccgctggctgtggtacatcaagatcttcatcatgatcgtgggcggcctgatcggcctgcgcatcgtgttcgccgtgctgagcgtgatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 40 - DNA, 6096 bp, Artificial Sequence
  plasmid VRC 5754
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcacccaagctagcatcaactgccaagcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgacccgtaaatccatgcgtatcggtccgggtcagaccttctacgctaccggtgacatcatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 41 - DNA, 7841 bp, Artificial Sequence
  plasmid VRC 5755
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacgctagcattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 42 - DNA, 7988 bp, Artificial Sequence
  plasmid VRC 5766
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagagatatcgccaccatgcgcgtgcgcggcatccagaccagctggcagaacctgtggcgctggggcaccatgatcctgggcatgctggtgatctacagcgccgccgagaacctgtgggtggccgtgtactacggcgtgcccgtgtggaaggacgccgagaccaccctgttctgcgccagcgacgccaaggcctacgacaccgaggtgcacaacgtgtgggagacccacgcctgcgtgcccaccgaccccaacccccaggagatccacctggagaacgtgaccgaggacttcaacatgtggcgcaacaacatggtggagcagatgcacaccgacatcatcagcctgtgggaccagagcctgaagccctgcgtgaagctgacccccctgtgcgtgaccctggactgcaacgccaccgccagcaacgtgaccaacgagatgcgcaactgcagcttcaacatcaccaccgagctgaaggacaagaagcagcaggtgtacagcctgttctacaagctggacgtggtgcagatcaacgagaagaacgagaccgacaagtaccgcctgatcaactgcaacaccagcgccatcacccaggcctgccccaaggtgagcttcgagcccatccccatccactactgcgcccccgccggcttcgccatcctgaagtgcaaggacaccgagttcaacggtaccggcccctgcaagaacgtgagcaccgtgcagtgcacccacggcatccgaccggtgatcagcacccagctgctgctgaacggcagcctggccgaggagggcatccagatccgcagcgagaacatcaccaacaacgccaagaccatcatcgtgcagctggataaggccgtgaagatcaactgcacccgccccacccgcaagggcgtgcgcatcggccccggccaggccttctacgccaccggcggcatcatccgccaggcccactgccacgtgagccgcgccaagtggaacgacaccctgcgcggcgtggccaagaagctgcgcgagcacttcaagaacaagaccatcatcttcgagaagagcagcggcggcgacatcgagatcaccacccacagcttcatctgcggcggcgagttcttctactgcaacaccagcggcctgttcaacagcacctgggagagcaacagcaccgagagcaacaacaccaccagcaacgacaccatcaccctgacctgccgcatcaagcagatcatcaacatgtggcagaaggtgggccaggccatgtaccccccccccatccagggcgtgatccgctgcgagagcaacatcaccggcctgctgctgacccgcgacggcggcaacaacagcaccaacgagatcttccgccccggcggcggcaacatgcgcgacaactggcgcagcgagctgtacaagtacaaggtggtgaagatcgagcccctgggcgtggcccccagccgcgccaagcttaccgcccaggcccgccagctgctgagcggcatcgtgcagcagcagagcaacctgctgcgcgccatcgaggcccagcagcacatgctgaagctgaccgtgtggggcatcaagcagctgcaggcccgcgtgctggccgtggagcgctacctgaaggaccagcagctcgagatctgggacaacatgacctggctgcagtgggacaaggagatcagcaactacacccagatcatctacaacctgatcgaggagagccagaaccagcaggagaagaacgagcaggacctgctggccctggacaagtgggccagcctgtggaactggttcgacatcagccgctggctgtggtgaacacgtgggatccgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 43 - DNA, 7844 bp, Artificial Sequence
  plasmid VRC 5767
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagagatatcgccaccatgcgcgtgcgcggcatccagaccagctggcagaacctgtggcgctggggcaccatgatcctgggcatgctggtgatctacagcgccgccgagaacctgtgggtggccgtgtactacggcgtgcccgtgtggaaggacgccgagaccaccctgttctgcgccagcgacgccaaggcctacgacaccgaggtgcacaacgtgtgggagacccacgcctgcgtgcccaccgaccccaacccccaggagatccacctggagaacgtgaccgaggacttcaacatgtggcgcaacaacatggtggagcagatgcacaccgacatcatcagcctgtgggaccagagcctgaagccctgcgtgaagctgacccccctgtgcgtgaccctggactgccaagccgctagcatcaactgccaaaccagcgccatcacccaggcctgccccaaggtgagcttcgagcccatccccatccactactgcgcccccgccggcttcgccatcctgaagtgcaaggacaccgagttcaacggtaccggcccctgcaagaacgtgagcaccgtgcagtgcacccacggcatccgaccggtgatcagcacccagctgctgctgaacggcagcctggccgaggagggcatccagatccgcagcgagaacatcaccaacaacgccaagaccatcatcgtgcagctggataaggccgtgaagatcaactgcacccgccccacccgcaagggcgtgcgcatcggccccggccaggccttctacgccaccggcggcatcatccgccaggcccactgccacgtgagccgcgccaagtggaacgacaccctgcgcggcgtggccaagaagctgcgcgagcacttcaagaacaagaccatcatcttcgagaagagcagcggcggcgacatcgagatcaccacccacagcttcatctgcggcggcgagttcttctactgcaacaccagcggcctgttcaacagcacctgggagagcaacagcaccgagagcaacaacaccaccagcaacgacaccatcaccctgacctgccgcatcaagcagatcatcaacatgtggcagaaggtgggccaggccatgtaccccccccccatccagggcgtgatccgctgcgagagcaacatcaccggcctgctgctgacccgcgacggcggcaacaacagcaccaacgagatcttccgccccggcggcggcaacatgcgcgacaactggcgcagcgagctgtacaagtacaaggtggtgaagatcgagcccctgggcgtggcccccagccgcgccaagcttaccgcccaggcccgccagctgctgagcggcatcgtgcagcagcagagcaacctgctgcgcgccatcgaggcccagcagcacatgctgaagctgaccgtgtggggcatcaagcagctgcaggcccgcgtgctggccgtggagcgctacctgaaggaccagcagctcgagatctgggacaacatgacctggctgcagtgggacaaggagatcagcaactacacccagatcatctacaacctgatcgaggagagccagaaccagcaggagaagaacgagcaggacctgctggccctggacaagtgggccagcctgtggaactggttcgacatcagccgctggctgtggtgaacacgtgggatccgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 44 - DNA, 7852 bp, Artificial Sequence
  plasmid VRC 5768
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagaatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctggttacgggtaacctggccgaggaggaggtggtgatccgcagcgctaacttcgccgacaacgccaaggtgatcatcgtgcagctgaacgagagcgtggagatcaactgcacccgccccacccgcaagggcgtgcgcatcggccccggccaggccttctacgccaccggcggcatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 45 - DNA, 7990 bp, Artificial Sequence
  plasmid VRC 5769
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgacccgtaaatccatgcgtatcggtccgggtcagaccttctacgctaccggtgacatcatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 46 - DNA, 7819 bp, Artificial Sequence
  plasmid VRC 5770
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcacccaagctagcatcaactgccaagcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgacccgtaaatccatgcgtatcggtccgggtcagaccttctacgctaccggtgacatcatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 47 - DNA, 6287 bp, Artificial Sequence
  plasmid VRC 5771
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgcgtgcgcggcatccagaccagctggcagaacctgtggcgctggggcaccatgatcctgggcatgctggtgatctacagcgccgccgagaacctgtgggtggccgtgtactacggcgtgcccgtgtggaaggacgccgagaccaccctgttctgcgccagcgacgccaaggcctacgacaccgaggtgcacaacgtgtgggagacccacgcctgcgtgcccaccgaccccaacccccaggagatccacctggagaacgtgaccgaggacttcaacatgtggcgcaacaacatggtggagcagatgcacaccgacatcatcagcctgtgggaccagagcctgaagccctgcgtgaagctgacccccctgtgcgtgaccctggactgcaacgccaccgccagcaacgtgaccaacgagatgcgcaactgcagcttcaacatcaccaccgagctgaaggacaagaagcagcaggtgtacagcctgttctacaagctggacgtggtgcagatcaacgagaagaacgagaccgacaagtaccgcctgatcaactgcaacaccagcgccatcacccaggcctgccccaaggtgagcttcgagcccatccccatccactactgcgcccccgccggcttcgccatcctgaagtgcaaggacaccgagttcaacggtaccggcccctgcaagaacgtgagcaccgtgcagtgcacccacggcatccgaccggtgatcagcacccagctgctgctgaacggcagcctggccgaggagggcatccagatccgcagcgagaacatcaccaacaacgccaagaccatcatcgtgcagctggataaggccgtgaagatcaactgcacccgccccacccgcaagggcgtgcgcatcggccccggccaggccttctacgccaccggcggcatcatccgccaggcccactgccacgtgagccgcgccaagtggaacgacaccctgcgcggcgtggccaagaagctgcgcgagcacttcaagaacaagaccatcatcttcgagaagagcagcggcggcgacatcgagatcaccacccacagcttcatctgcggcggcgagttcttctactgcaacaccagcggcctgttcaacagcacctgggagagcaacagcaccgagagcaacaacaccaccagcaacgacaccatcaccctgacctgccgcatcaagcagatcatcaacatgtggcagaaggtgggccaggccatgtaccccccccccatccagggcgtgatccgctgcgagagcaacatcaccggcctgctgctgacccgcgacggcggcaacaacagcaccaacgagatcttccgccccggcggcggcaacatgcgcgacaactggcgcagcgagctgtacaagtacaaggtggtgaagatcgagcccctgggcgtggcccccagccgcgccaagcttaccgcccaggcccgccagctgctgagcggcatcgtgcagcagcagagcaacctgctgcgcgccatcgaggcccagcagcacatgctgaagctgaccgtgtggggcatcaagcagctgcaggcccgcgtgctggccgtggagcgctacctgaaggaccagcagctcgagatctgggacaacatgacctggctgcagtgggacaaggagatcagcaactacacccagatcatctacaacctgatcgaggagagccagaaccagcaggagaagaacgagcaggacctgctggccctggacaagtgggccagcctgtggaactggttcgacatcagccgctggctgtggtacatcaagatcttcatcatgatcgtgggcggcctgatcggcctgcgcatcgtgttcgccgtgctgagcgtgatctgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccctttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 48 - DNA, 6133 bp, Artificial Sequence
  plasmid VRC 5772
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatgctgatgatctgcagcgccaccgagaagctgtgggtgaccgtgtactacggcgtgcccgtgtggaaggaggccaccaccaccctgctctgcgccagcgacgccaaggcctacgacaccgaggtgcacaacgtgtgggccacccacgcctgcgtgcccaccgaccccaacccccaggaggtggtgctggtgaacgtgaccgagaacttcgacatgtggaagaacgacatggtggagcagatgcacgaggacatcatcagcctgtgggaccagagcctgaagccctgcgtgaagctgacccccctgtgcgtgagcctgaagtgcaccgacgctagcaccagctgcaacaccagcgtgatcacccaggcctgccccaaggtgagcttcgagcccatccccaaccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctggttacgggtaacctggccgaggaggaggtggtgatccgcagcgctaacttcgccgacaacgccaaggtgatcatcgtgcagctgaacgagagcgtggagatcaactgcacccgccccacccgcaagggcgtgcgcatcggccccggccaggccttctacgccaccggcggcatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgagttcttctactgcaacagcacccagctgttcaacagcacctggttcaacagcacctggagcaccgagggcagcaacaacaccgagggcagcgacaccatcaccctgccctgccgcatcaagcagatcatcaacatgtggcagaaggtgggcaaggccatgtacgccccccccatcagcggccagatccgctgcagcagcaacatcaccggcctgctgctgacccgcgacggcggcaacagcaacaacgagagcgagatcttccgcctgggcggcggcgacatgcgcgacaactggcgcagcgagctgtacaagtacaaggtggtgaagatcgagcccctgggcgtggcccccaccaaggccaagcttaccgtccaggcccgccagctgctgagcggcatcgtgcagcagcagaacaacctgctgcgcgccatcgaggcccagcagcacctgctgcagctgaccgtgtggggcatcaagcagctgcaggcccgcaccctggccgtggagcgctacctgaaggaccagcagcagctcgagcagatctggaaccacaccacctggatggagtgggaccgcgagatcaacaactacaccagcctgatccacagcctgatcgaggagagccagaaccagcaggagaagaacgagcaggagctgctggagctggacaagtgggccagcctgtggaactggttcaacatcaccaactggctgtggtacatcaagctgttcatcatgatcgtgggcggcctggtgggcctgcgcatcgtgttcgccgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 49 - DNA, 6280 bp, Artificial Sequence
  plasmid VRC 5773
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaactgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgacccgtaaatccatgcgtatcggtccgggtcagaccttctacgctaccggtgacatcatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 50 - DNA, 6196 bp, Artificial Sequence
  plasmid CMVR-gp145dCFIdV1(V2dLR)(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacgctagcaaggactgcagcttcgacatcaccaaggagtacgccctgttctacaagctggacatcgcccccatcgactatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 51 - DNA, 6319 bp, Artificial Sequence
  plasmid CMVR-gp145dCFI(V12dg)(V3 1AB)(Bal)gb
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcgacgccaccaacggagacgacacagacacaacaagcagcagcagaggaatggtgggaggaggcgagatgaaggactgcagcttcgacatcaccaccaacatccgcggcaaggtgcagaaggagtacgccctgttctacaagctggacatcgcccccatcgacgacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaagccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 52 - DNA, 6265 bp, Artificial Sequence
  plasmid CMVR-gp145dCFI(V1dG)(V2dLR)(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcgacgccaccaacggagacgacacagacacaacaagcagcagcagaggaatggtgggaggaggcgagatgaaggactgcagcttcgacatcaccaaggagtacgccctgttctacaagctggacatcgcccccatcgactatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 53 - DNA, 6262 bp, Artificial Sequence
  plasmid CMVR-gp145dCFI(V1dG)(V2dM)(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcgacgccaccaacggagacgacacagacacaacaagcagcagcagaggaatggtgggaggaggcgagatgaaggactgcagcttcgacatcaccaccaacatccgcggcaaggtgcaggacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 54 - DNA, 6208 bp, Artificial Sequence
  plasmid CMVR-gp145dCFI(V1dG)dV2(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcgacgccaccaacggagacgacacagacacaacaagcagcagcagaggaatggtgggaggaggcgagatgaaggactgcagcttcgctagcattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 55 - DNA, 6277 bp, Artificial Sequence
  plasmid CMVR-gp145dCFI(V1dLR)(V2dG)(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacaacggagacgacacagacacaacaagcagcagcagaggaatggtgaaggactgcagcttcgacatcaccaccaacatccgcggcaaggtgcagaaggagtacgccctgttctacaagctggacatcgcccccatcgacgacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 56 - DNA, 6178 bp, Artificial Sequence
  plasmid CMVR-gp145dCFI(V1dLR)dV2(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacaacggagacgacacagacacaacaagcagcagcagaggaatggtgaaggactgcagcttcgctagcattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 57 - DNA, 6280 bp, Artificial Sequence
  plasmid CMVR-gp145dCFI(V1dM)(V2dG)(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcgacgccaccaacggagacgacacagacggaggaggcgagatgaaggactgcagcttcgacatcaccaccaacatccgcggcaaggtgcagaaggagtacgccctgttctacaagctggacatcgcccccatcgacgacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 58 - DNA, 6181 bp, Artificial Sequence
  plasmid CMVR-gp145dCFI(V1dM)dV2(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcgacgccaccaacggagacgacacagacggaggaggcgagatgaaggactgcagcttcgctagcattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 59 - DNA, 6307 bp, Artificial Sequence
  plasmid CMVR-gp145dCFI(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 60 - DNA, 6238 bp, Artificial Sequence
  plasmid CMVR-gp145dCFIdV1(V2dG)(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacgctagcaaggactgcagcttcgacatcaccaccaacatccgcggcaaggtgcagaaggagtacgccctgttctacaagctggacatcgcccccatcgacgacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 61 - DNA, 6193 bp, Artificial Sequence
  plasmid CMVR-gp145dCFIdV1(V2dM)(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacgctagcaaggactgcagcttcgacatcaccaccaacatccgcggcaaggtgcaggacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 62 - DNA, 6238 bp, Artificial Sequence
  plasmid CMVR-gp145dCFIdV1(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacgctagcaagaactgcagcttcaacatcaccaccaacatccgcggcaaggtgcagaaggagtacgccctgttctacaagctggacatcgcccccatcgacaacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 63 - DNA, 6118 bp, Artificial Sequence
  plasmid CMVR-gp145dCFIdV1V2(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacgctagcattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 64 - DNA, 6208 bp, Artificial Sequence
  plasmid CMVR-gp145dCFIdV2(V3-1AB)(Bal)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcgctagcattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccacccgcaagagcatccacatcggccccggccgcgccttctacaccaccggcgagatcatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 65 - DNA, 8035 bp, Artificial Sequence
  plasmid VRC 5781
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaattgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 66 - DNA, 6312 bp, Artificial Sequence
  plasmid VRC 5782
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaattgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 67 - DNA, 8051 bp, Artificial Sequence
  plasmid VRC 5783
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 68 - DNA, 6328 bp, Artificial Sequence
  plasmid VRC 5784
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 69 - DNA, 8021 bp, Artificial Sequence
  plasmid VRC 5785
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 70 - DNA, 6298 bp, Artificial Sequence
  plasmid VRC 5786
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 71 - DNA, 8048 bp, Artificial Sequence
  plasmid VRC 5787
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 72 - DNA, 6325 bp, Artificial Sequence
  plasmid VRC 5788
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccttacctgaggccgccatccacgccggttgagtcgcgttctgccgcctcccgcctgtggtgcctcctgaactacgtccgccgtctaggtaagtttagagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgtccaggcccgcctgctgctgagcggcatcgtgcagcagcagaacaacctgctgcgcgccatcgaggcccagcagcacctgctgcagctgaccgtgtggggcatcaagcagctgcaggcccgcgtgctggccgtggagcgctacctgcgcgaccagcagctcctcaagatctgggacaacatgacctggatcgagtgggaccgcgagatcaacaactacaccagcatcatctacagcctgatcgaggagagccagaaccagcaggagaagaacgagcaggagctgctggagctggacaagtgggccagcctgtggaactggttcgacatcaccaagtggctgtggtacatcaagatcttcatcatgatcgtgggcggcctgatcggcctgcgcatcgtgttcagcgtgctgagcatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 73 - DNA, 8021 bp, Artificial Sequence
  plasmid VRC 5789
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 74 - DNA, 6311 bp, Artificial Sequence
  plasmid VRC 5790
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgcgcgtgaaggagaagtaccagcacctgtggcgctggggctggcgctggggcaccatgctgctgggcatcctgatgatctgcaacgccgaggagaagctgtgggtgaccgtgtactacggcgtgcccgtgtggaaggaggccaccaccaccctgttctgcgccagcgaccgcaaggcctacgacaccgaggtgcacaacgtgtgggccacccacgcctgcgtgcccaccgaccccaacccccaggaggtggagctgaagaacgtgaccgagaacttcaacatgtggaagaacaacatggtggagcagatgcacgaggacatcatcagcctgtgggaccagagcctgaagccctgcgtgaagctgacccccctgtgcgtgaccctgaactgcaccgacctgcgcaacgccaccaacggaaacgacacaaacacaacaagcagcagcagaggaatggtgggaggaggcgagatgaagaactgcagcttcaacatcaccaccaacatccgcggcaaggtgcagaaggagtacgccctgttctacaagctggacatcgcccccatcgacaacaactccaacaacagatatagactgattagctgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 75 - DNA, 8005 bp, Artificial Sequence
  plasmid VRC 5791
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaattgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 76 - DNA, 6295 bp, Artificial Sequence
  plasmid VRC 5792
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaattgcaacaccagcgtgatcacccaggcctgccccaaggtgagcttcgagcccatccccatccactactgcgcccccgccggcttcgccatcctgaagtgcaaggacaagaagttcaacggcaagggcccctgcaccaacgtgagcaccgtgcagtgcacccacggcatccgccccgtggtgagcacccagctgctgctgaacggtagcctggccgaggaggaggtggtgatccgcagcgctaacttcgccgacaacgccaaggtgatcatcgtgcagctgaacgagagcgtggagatcaactgcacccgccccaacaacaacacccgcaagagcatccacatcggccccggccgcgccttctacaccaccggcgagatcatcggcgacatccgccaggcccactgcaacctgagccgcgccaagtggaacgacaccctgaacaagatcgtgatcaagctgcgcgagcagttcggcaacaagaccatcgtgttcaagcacagcagcggcggcgaccccgagatcgtgacccacagcttcaactgcggcggcgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 77 - DNA, 8035 bp, Artificial Sequence
  plasmid VRC 5793
ttaattaaccgcaattctcatgtttgacagcttatcatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagtacgtaccagtgcactggcctagagcggccccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaattgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcagcacagcaagggggaggattgggaagacaatagcaggcatgctggggatgcggtgggctctatgggtacccagggccgcataacttcgtataatgtatgctatacgaagttataagatctgtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgtt

SEQ ID NO: 78 - DNA, 6325 bp, Artificial Sequence
  plasmid VRC 5794
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaattgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacagcacccagctgtttaattccacatggaacgtgaccgaggagagcaacaacaccgtggagaacaacaccatcaccctgccctgccgcatcaagcagatcatcaacatgtggcaggaggtgggccgcgccatgtacgccccccccatccgcggccagatccgctgcagcagcaacatcaccggcctgctgctgacccgcgacggcggccccgaggacaacaagaccgaggtgttccgccctggcggcggcgacatgcgcgacaactggcgcagcgagctgtacaagtacaaggtggtgaagatcgagcccctgggcgtggcccccaccaaggccaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 79 - DNA, 6298 bp, Artificial Sequence
  plasmid CMVR gp145 dCFI (CCCC)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgcgtgttcgtggtatcccgcgtaactggccgcagtggtggatgtggggtatcctgggtttctggatgatcatcatctgccgtgttgttggtaacatgtgggttaccgtttactacggtgttccggtttggaccgacgctaaaaccaccctgttctgcgcttccgacaccaaagcctacgaccgtgaagttcacaacgtttgggctacccacgcttgcgttccgaccgacccgaacccgcaggaaatcgttctggaaaacgttaccgaaaacttcaacatgtggaaaaacgacatggttgaccagatgcacgaagacatcatctccctgtgggaccagtccctgaaaccgtgcgttaaactgaccccgctgtgcgttaccctgcactgcaccaacgctaccttcaaaaacaacgttaccaacgacatgaacaaagaaatccgtaactgctccttcaacaccaccaccgaaatccgtgacaaaaaacagcagggttacgctctgttctaccgtccggacatcgttctgctgaaagaaaaccgtaacaactccaacaactccgaatacatcctgatcaattgcaacgcttccaccatcacccaggcttgcccgaaagttaacttcgacccgatcccgatccactactgcgctccggctggttacgctatcctgaaatgcaacaacaaaaccttctccggtaaaggtccgtgcaacaacgtttccaccgttcagtgcacccatggtatcaaaccggttgtttccacccagctgctgctgaacggttccctggctgaaaaagaaatcatcatccgttccgaaaacctgaccgacaacgttaaaaccatcatcgttcacctgaacaaatccgttgaaatcgtttgcacccgtccgaacaacaacacccgtaaatccatgcgtatcggtccgggtcagaccttctacgctaccggtgacatcatcggtgacatccgtcaggcttactgcaacatctccggttccaaatggaacgaaaccctgaaacgtgttaaagaaaaactgcaggaaaactacaacaacaacaaaaccatcaaattcgctccgtcctccggtggtgacctggaaatcaccacccactccttcaactgccgtggtgaattcttctactgcaacaccacccgtctgttcaacaacaacgctaccgaagacgaaaccatcaccctgccgtgccgtatcaaacagatcatcaacatgtggcagggtgttggtcgtgctatgtacgctccgccgatcgctggtaacatcacctgcaaatccaacatcaccggtctgctgctggttcgtgacggtggtgaagacaacaaaaccgaagaaatcttccgtccgggtggtggtaacatgaaagacaactggcgttccgaactgtacaaatacaaagttatcgaactgaaaccgctgggtatcgctccgaccggtgctaagcttaccgttcaggctcgtcagctgctgtcctccatcgttcagcagcagtccaacctgctgcgtgctatcgaagctcagcagcacatgctgcagctgaccgtttggggtatcaaacagctgcagacccgtgttctggctatcgaacgttacctgaaagaccagcagctcgagatctggaacaacatgacctggatggaatgggaccgtgaaatctccaactacaccgacaccatctaccgtctgctggaagactcccagacccagcaggaaaaaaacgaaaaagacctgctggctctggactcctggaaaaacctgtggtcctggttcgacatctccaactggctgtggtacatcaaaatcttcatcatgatcgttggtggtctgatcggtctgcgtatcatcttcgctgttctgtccatctgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

What is claimed is:

1. A composition for inducing an immune response against HIV comprising nucleic acids encoding 1) modified clade A, B, and C Env polypeptides, or immunogenic fragments thereof or Env chimeras comprising modified clade A, B, and C Env polypeptides or immunogenic fragments thereof and 2) Gag-Pol or Gag-Pol-Nef from a single clade.

2. Isolated and purified multiclade HIV envelope immunogens comprising Env DNA from clades A, B, and C.

3. The composition of claim 1 further comprising V1, V2, V3, or V4 deletions or combinations thereof.

4. The composition of claim 1, wherein said nucleic acids comprise plasmids.

5. The composition of claim 4 wherein each of said modified clade A, B, and C Env polypeptides or each of said Env chimeras comprising modified clade A, B, and C Env polypeptides is encoded by a different plasmid.

6. The composition of claim 1, wherein said nucleic acids comprise viral vectors.

7. The composition of claim 6 wherein each of said modified clade A, B, and C Env polypeptides or each of said Env chimeras comprising modified clade A, B, and C Env polypeptides is encoded by a different viral vector.

8. The composition of claim 1, wherein said modified clade A, B, and C Env polypeptides or Env chimeras comprising modified clade A, B, and C Env polypeptides comprise deletions of the fusion and cleavage domains and the interspace between heptad (H) 1 and 2.

9. The composition of claim 1, wherein said nucleic acids encoding modified clade A, B and C Env polypeptides or Env chimeras comprising modified clade A, B, and C Env polypeptides comprise codons optimized for human expression.

10. The composition of claim 9, wherein the modified clade A and C Env polypeptides encoded by said nucleic acids are not Env chimeras.

11. The composition of claim 10, wherein the modified clade B Env polypeptides encoded by said nucleic acids are chimeras.

12. The composition of claim 11, wherein said chimera is an HXB/BaL chimera.

13. The composition of claim 12, wherein said chimera comprises deletions of V1 and V2.

14. The composition of claim 1, wherein said modified clade A, B and C Env polypeptides or Env chimeras comprising modified clade A, B, and C Env polypeptides are CCR-5 tropic.

15. The composition of claim 9, wherein said nucleic acids encoding modified clade A, B, and C Env polypeptides or Env chimeras comprising modified clade A, B, and C Env polypeptides encode gp145.

16. The composition of claim 15, comprising nucleic acids encoding modified clade A and C Env polypeptides which are not Env chimeras.

17. The composition of claim 16, wherein the nucleic acid encoding modified clade B Env polypeptides is a chimera.

18. The composition of claim 17, wherein said chimera is an HXB/BaL chimera.

19. The composition of claim 15, wherein said gp145 comprises deletions of fusion and cleavage domains and the interspace between heptad (H) 1 and 2.

20. The composition of claim 15, wherein said modified clade A, B and C Env polypeptides or Env chimeras comprising modified clade A, B, and C Env polypeptides are CCR-5 tropic.

21. The composition of claim 15, wherein said nucleic acids are plasmids.

22. The composition of claim 21 wherein each of said modified clade A, B, and C Env polypeptides or each of said Env chimeras comprising modified clade A, B, and C Env polypeptides is encoded by a different plasmid.

23. The composition of claim 9, wherein said nucleic acids encoding modified clade A, B, and C Env polypeptides or Env chimeras comprising modified clade A, B, and C Env polypeptides encode gp140.

24. The composition of claim 23, comprising nucleic acids encoding modified clade A and C Env polypeptides which are not Env chimeras.

25. The composition of claim 24, wherein the nucleic acid encoding modified clade B Env polypeptides is a chimera.

26. The composition of claim 25, wherein said chimera is an HXB/BaL chimera.

27. The composition of claim 23, wherein said gp140 comprises deletions of fusion and cleavage domains and the interspace between heptad (H) 1 and 2.

28. The composition of claim 23, wherein said modified clade A, B and C Env polypeptides or Env chimeras comprising modified clade A, B, and C Env polypeptides are CCR-5 tropic.

29. The composition of claim 23, wherein said nucleic acids are viral vectors.

30. The composition of claim 23 wherein each of said modified clade A, B, and C Env polypeptides or each of said Env chimeras comprising modified clade A, B, and C Env polypeptides is encoded by a different viral vector.

31. A composition comprising (a) a plasmid encoding gp145 of clade A;

(b) a plasmid encoding gp145 of clade B; and (c) a plasmid encoding gp145 of clade C.

32. The composition of claim 31, wherein said plasmid encoding gp145 of clade A comprises codons optimized for human expression, said plasmid encoding gp145 of clade B comprises codons optimized for human expression and said plasmid encoding gp145 of clade C comprises codons optimized for human expression.

33. The composition of claim 31, wherein said plasmid encoding gp145 of clade A comprises deletions of the fusion and cleavage domains and the interspace between heptad (H) 1 and 2, said plasmid encoding gp145 of clade B comprises deletions of the fusion and cleavage domains and the interspace between heptad (H) 1 and 2 and said plasmid encoding gp145 of clade C comprises deletions of the fusion and cleavage domains and the interspace between heptad (H) 1 and 2.

34. The composition of claim 31, wherein said plasmid encoding gp145 of clade B encodes a chimeric gp145.

35. The composition of claim 34, wherein said chimeric gp145 is an HXB/BaL chimera.

36. The composition of claim 23 wherein each of said modified clade A, B, and C Env polypeptides or each of said Env chimeras comprising modified clade A, B, and C Env polypeptides is encoded by a different viral vector.

37. A composition comprising (a) a viral vector encoding gp140 of clade A;

(b) a viral vector encoding gp140 of clade B; and (c) a viral vector encoding gp140 of clade C.

38. The composition of claim 37, wherein said viral vector encoding gp140 of clade A comprises codons optimized for human expression, said viral vector encoding gp140 of clade B comprises codons optimized for human expression and said viral vector encoding gp140 of clade C comprises codons optimized for human expression.

39. The composition of claim 38, wherein said viral vector encoding gp140 of clade A comprises deletions of the fusion and cleavage domains and the interspace between heptad (H) 1 and 2, said viral vector encoding gp140 of clade B comprises deletions of the fusion and cleavage domains and the interspace between heptad (H) 1 and 2 and said viral vector encoding gp140 of clade C comprises deletions of the fusion and cleavage domains and the interspace between heptad (H) 1 and 2.

40. The composition of claim 38, wherein said viral vector encoding gp140 of clade B encodes a chimeric gp140.

41. The composition of claim 40, wherein said chimeric gp140 is an HXB/BaL chimera.

42. The composition of claim 38, wherein said viral vector encoding gp140 of clade B encodes a gp140 with deletions of V1 and V2.

* * * * *

UNITED STATES PATENT AND TRADEMARK OFFICE
Certificate

Patent No. 7,666,427 B2                        Patented: February 23, 2010

On petition requesting issuance of a certificate for correction of inventorship pursuant to 35 U.S.C. 256, it has been found that the above identified patent, through error and without any deceptive intent, improperly sets forth the inventorship.

Accordingly, it is hereby certified that the correct inventorship of this patent is: Gary J. Nabel, Washington, DC (US); Bimal Chakrabarti, Gaithersburg, MD (US); Wing-pui Kong, Germantown, MD (US); Yue Huang, Bethesda, MD (US); engguang Wang, legal representative, Silver Spring, MD (US); Zhi-yong Yang, Potomac, MD (US); Jason G. D. Gall, Germantown, MD (US); and C. Richter King, New York, NY (US).

Signed and Sealed this Twenty-first Day of February 2012.

*ZACHARIAH LUCAS*
*Supervisory Patent Examiner*
Art Unit 1648
Technology Center 1600

UNITED STATES PATENT AND TRADEMARK OFFICE
Certificate

Patent No. 7,666,427 B2                                                          Patented: February 23, 2010

On petition requesting issuance of a certificate for correction of inventorship pursuant to 35 U.S.C. 256, it has been found that the above identified patent, through error and without any deceptive intent, improperly sets forth the inventorship.

Accordingly, it is hereby certified that the correct inventorship of this patent is: Gary J. Nabel, Washington, DC (US); Bimal Chakrabarti, Gaithersburg, MD (US); Wing-pui Kong, Germantown, MD (US); Yue Huang, Bethesda, MD (US); Zengguang Wang, legal representative, Silver Spring, MD (US); Zhi-yong Yang, Potomac, MD (US); Jason G. D. Gall, Germantown, MD (US); and C. Richter King, New York, NY (US).

Signed and Sealed this Twenty-second Day of May 2012.

<div style="text-align:right">
ZACHARIAH LUCAS<br>
<i>Supervisory Patent Examiner</i><br>
Art Unit 1648<br>
Technology Center 1600
</div>